US012662539B2

(12) United States Patent　　(10) Patent No.: US 12,662,539 B2
Gelfman et al.　　　　　　　　　(45) Date of Patent: *Jun. 23, 2026

(54) MODULATION OF ENDOPLASMIC RETICULUM AMINOPEPTIDASE 2 (ERAP2)-MEDIATED IMMUNE RESPONSE

(71) Applicant: Regeneron Pharmaceuticals, Inc., Tarrytown, NY (US)

(72) Inventors: Sahar Gelfman, Tarrytown, NY (US); Ann Ligocki, Tarrytown, NY (US); Giovanni Coppola, Tarrytown, NY (US); Aris Baras, Tarrytown, NY (US); Arden Moscati, Tarrytown, NY (US); Eli A. Stahl, Tarrytown, NY (US); Jack A. Kosmicki, Tarrytown, NY (US); Manuel Allen Revez Ferreira, Tarrytown, NY (US); Carmelo Romano, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 840 days.

This patent is subject to a terminal disclaimer.

(21) Appl. No.: 17/384,601

(22) Filed: Jul. 23, 2021

(65) Prior Publication Data

US 2023/0059929 A1　　Feb. 23, 2023

Related U.S. Application Data

(60) Provisional application No. 63/056,562, filed on Jul. 25, 2020, provisional application No. 63/171,672, filed on Apr. 7, 2021.

(51) Int. Cl.
| | |
|---|---|
| *A61K 31/00* | (2006.01) |
| *A61K 31/713* | (2006.01) |
| *A61K 38/08* | (2019.01) |
| *A61K 45/06* | (2006.01) |
| *C07K 16/28* | (2006.01) |
| *C12N 15/113* | (2010.01) |

(52) U.S. Cl.
CPC ........ *C07K 16/2833* (2013.01); *A61K 31/713* (2013.01); *A61K 38/08* (2013.01); *A61K 45/06* (2013.01); *C12N 15/113* (2013.01); *C12N 2310/11* (2013.01); *C12N 2310/14* (2013.01); *C12N 2310/531* (2013.01); *C12N 2320/30* (2013.01)

(58) Field of Classification Search
CPC .. C07K 16/2833; A61K 31/713; A61K 38/08; A61K 45/06; C12N 15/113; C12N 2310/11; C12N 2310/14; C12N 2310/531; C12N 2320/30
See application file for complete search history.

(56) References Cited

U.S. PATENT DOCUMENTS

| | | | |
|---|---|---|---|
| 8,969,254 | B2 | 3/2015 | Reinherz et al. |
| 9,617,596 | B2 | 4/2017 | Comabella et al. |
| 9,907,833 | B2 | 3/2018 | Conrad |
| 10,047,396 | B2 | 8/2018 | Sharp et al. |
| 10,166,210 | B2 | 1/2019 | Pogue-Geile et al. |
| 10,385,398 | B2 | 8/2019 | Hakonarson et al. |
| 10,407,725 | B2 | 9/2019 | Hakonarson et al. |
| 10,927,412 | B2 | 2/2021 | Giudice et al. |
| 2003/0228314 | A1 | 12/2003 | Shastri et al. |
| 2012/0015904 | A1 | 1/2012 | Sharp et al. |
| 2015/0141273 | A1 | 5/2015 | Bosch et al. |
| 2016/0145687 | A1 | 5/2016 | Kallionpaa et al. |
| 2017/0199196 | A1 | 7/2017 | Bosch et al. |
| 2019/0076391 | A1 | 3/2019 | Pogue-Geile et al. |
| 2019/0136322 | A1 | 5/2019 | Kallionpaa et al. |
| 2019/0241633 | A1 | 8/2019 | Fotin-Mleczek et al. |
| 2019/0375842 | A1 | 12/2019 | Drake |
| 2020/0080152 | A1 | 3/2020 | Hakonarson et al. |
| 2021/0002296 | A1 | 1/2021 | Mainolfi et al. |
| 2021/0147799 | A1 | 5/2021 | Zhang et al. |

FOREIGN PATENT DOCUMENTS

| | | |
|---|---|---|
| WO | 2012047294 | 4/2012 |
| WO | 2013152001 | 10/2013 |
| WO | 2014171800 | 10/2014 |
| WO | 2017208001 | 12/2017 |
| WO | 202111376 | 6/2021 |
| WO | 2021113805 | 6/2021 |
| WO | 2022026336 | 2/2022 |

OTHER PUBLICATIONS

Babaie et al, Molecule Immunology 121: 7-19, Epub Mar. 2, 2020, IDS # 5, filed on Dec. 21, 2021 (Year: 2020).*
Kato et al (J Immunology 143: 3371-3378, 1989 (Year: 1989).*
Lopes de Castro et al (mole Immunology 77:193-204, 2016 (Year: 2016).*
Gelfman et al (IOVS 62 (14):3 2021) (Year: 2021).*
Castro-Santos et al., "ERAPI and HLA-C interaction in inflammatory bowel disease in the Spanish population", Innate Immunity, 2017, 23(5), pp. 476-481.
Chiaroni-Clarke et al., "Independent confirmation of juvenile idiopathic arthritis genetic risk loci previously identified by immunochip array analysis", Pediatric Rheumatology, 2014, 12(53), pp. 1-4.
Deddouche-Grass et al., "Discovery and Optimization of a Series of Benzofuran Selective ERAP1 Inhibitors: Biochemical and In Silico Studies", ACS Med Chem Lett, 2021, 12, pp. 1137-1142.

(Continued)

*Primary Examiner* — Lei Yao
(74) *Attorney, Agent, or Firm* — Armstrong Teasdale LLP

(57) ABSTRACT

The present disclosure provides methods of treating subjects having an immune disorder by administering a therapeutically effective amount of an Endoplasmic Reticulum Aminopeptidase 2 (ERAP2) inhibitor to the subject, and optionally an Endoplasmic Reticulum Aminopeptidase 1 (ERAP1) agonist or inhibitor and/or an HLA-Aw19 inhibitor, and also provides methods of identifying subjects having an increased risk for developing an MHC-I-opathy.

6 Claims, 15 Drawing Sheets

Specification includes a Sequence Listing.

(56) References Cited

OTHER PUBLICATIONS

Franke et al., "Genome-wide meta-analysis increases to 71 the number of confirmed Crohn's disease susceptibility loci", Nature Genetics, 2010, 42(12), pp. 1118-1126.

Liddle et al., "Targeting the Regulatory Site of ER Aminopeptidase 1 Leads to the Discovery of a Natural Product Modulator of Antigen Presentation", J Med Chem, 2020, 63(6), pp. 3348-3358.

Weglarz-Tomczak et al., "Discovery of potent and selective inhibitors of human aminopeptidases ERAP1 and ERAP2 by screening libraries of phosphorus-containing amino acid and dipeptide analogues", Bioorganic and Medicinal Chemistry Letters, 2016, 26, pp. 4122-4126.

Zervoudi et al., "Rationally designed inhibitor targeting antigentrimming aminopeptidases enhances antigen presentation and cytotoxic T-cell responses", PNAS, 2013, 110(49), pp. 19890-19895.

Van Hout et al., "Exome sequencing and characterization of 49,960 individuals in the UK Biobank", Nature, 2020, 586(7831), pp. 749-756.

Reid et al., "Launching genomics into the cloud: deployment of Mercury, a next generation sequence analysis pipeline", BMC Bioinformatics, 2014, 15(30), pp. 1-11.

Bai et al., "Inference of high resolution HLA types using genome-wide RNA or DNA sequencing reads", BMC Genomics, 2014, 15(325), pp. 1-16.

Robinson et al., "The IPD-IMGT/HLA Database—New developments in reporting HLA variation", Hum Immunol, 2016, 77(3), pp. 233-237.

Jia et al., "Imputing Amino Acid Polymorphisms in Human Leukocyte Antigens", PLOS One, 2013, 8(6), pp. e64683.

Rich et al., "The Type 1 Diabetes Genetics Consortium", Ann NY Acad Sci, 2006, 1079, pp. 1-8.

Delaneau et al., "Accurate, scalable and integrative haplotype estimation", Nature Communications, 2019, 10(5436), pp. 1-10.

Das et al., "Next-generation genotype imputation service and methods", Nat Genet, 2016, 48(10), pp. 1284-1287.

Mbatchou et al., "Computationally efficient whole genome regression for quantitative and binary traits", BioRxiv, 2020, pp. 1-88.

Zhou et al., "Efficiently controlling for case-control imbalance and sample relatedness in large-scale genetic association studies", Nature Genetics, 2018, 50, pp. 1335-1341.

Purcell et al., "PLINK: a tool set for whole-genome association and population-based linkage analyses", Am J Hum Genet, 2007, 81(3), pp. 559-575.

Kuiper et al., "A genome-wide association study identifies a functional ERAP2 haplotype associated with birdshot chorioretinopathy", Hum Mol Genet, 2014, 23(22), pp. 6081-6087.

Kuiper et al., "Functionally distinct ERAP1 and ERAP2 are a hallmark of HLA-A29-(Birdshot) Uveitis", Hum Mol Genet, 2018, 27(24), pp. 4333-4343.

Paladini et al., "An allelic variant in the intergenic region between ERAP1 and ERAP2 correlates with an inverse expression of the two genes", Scientific Reports, 2018, 8(10398), pp. 1-10.

Andres et al., "Balancing Selection Maintains a Form of ERAP2 that Undergoes Nonsense-Mediated Decay and Affects Antigen Presentation", PLOS Genetics, 2010, 6(10), pp. e1001157.

Coulombe-Huntington et al., "Fine-Scale Variation and Genetic Determinants of Alternative Splicing across Individuals", PLOS Genetics, 2009, 5(12), pp. e1000766.

Sanz-Bravo et al., "Allele-specific Alterations in the Peptidome Underlie the Joint Association of HLA-A*29:02 and Endoplasmic Reticulum Aminopeptidase 2 (ERAP2) with Birdshot Chorioretinopathy", Mol Cell Proteomics, 2018, 17 (8), pp. 1564-1577.

Yao et al., "Influence of ERAP1 and ERAP2 gene polymorphisms on disease susceptibility in different populations", Human Immunology, 2019, 80(5), pp. 325-334.

Evans et al., "Interaction between ERAP1 and HLA-B27 in ankylosing spondylitis implicates peptide handling in the mechanism for HLA-B27 in disease susceptibility", Nat Genet, 2011, 43(8), pp. 761-767.

Wisniewski et al., "The association of ERAP1 and ERAP2 single nucleotide polymorphisms and their haplotypes with psoriasis vulgaris is dependent on the presence or absence of the HLA-C*06:02 allele and age at disease onset", Hum Immunol, 2018, 79(2), pp. 109-116.

Strange et al., "A genome-wide association study identifies new psoriasis susceptibility loci and an interaction between HLA-C and ERAP1", Nat Genet, 2010, 42(11), pp. 985-990.

Takeuchi et al., "A single endoplasmic reticulum aminopeptidase-1 protein allotype is a strong risk factor for Behçet's disease in HLA-B*51 carriers", Ann Rheum Dis, 2016, 75(12), pp. 2208-2211.

Sanz-Bravo et al., "Ranking the Contribution of Ankylosing Spondylitis-associated Endoplasmic Reticulum Aminopeptidase 1 (ERAP1) Polymorphisms to Shaping the HLA-B*27 Peptidome*", Mol Cell Proteomics, 2018, 17(7), pp. 1308-1323.

Guasp et al., "The Behçet's disease-associated variant of the aminopeptidase ERAP1 shapes a low-affinity HLA-B*51 peptidome by differential subpeptidome processing", J Biol Chem, 2017, 292(23), pp. 9680-9689.

Mckenzie et al., "Taxonomic hierarchy of HLA class I allele sequences", Genes and Immunity, 1999, 1, pp. 120-129.

Maben et al., "Discovery of Selective Inhibitors of Endoplasmic Reticulum Aminopeptidase 1", J Med Chem, 2020, 63, pp. 103-121.

Lopez De Castro, "How ERAP1 and ERAP2 Shape the Peptidomes of Disease-Associated MHC-I Proteins", Front Immunol, 2018, 9(2463), pp. 1-17.

Worth et al., "Novel Therapeutic Targets in Axial Spondyloarthritis", Curr Treat Options in Rheum, 2018, 4, pp. 174-182.

Chen et al., "Silencing or inhibition of endoplasmic reticulum aminopeptidase 1 (ERAP1) suppresses free heavy chain expression and Th17 responses in ankylosing spondylitis", Ann Rheum Dis, 2016, 75, pp. 916-923.

Non-Final Office Action dated Apr. 2, 2024 in related U.S. Appl. No. 17/714,717.

Notice of Allowance dated Mar. 26, 2025 in related U.S. Appl. No. 17/714,717.

Notice of Allowance dated Apr. 24, 2025 in related U.S. Appl. No. 17/714,717.

Freitas-Neto et al., "Birdshot retinochoroidopathy review", Arq Bras Oftalmol, 2015, 78(1), pp. 56-61.

Ferenchak et al., "Antisense Oligonucleotide Therapy for Ophthalmic Conditions", Seminars in Ophthalmology, 2021, 36(5-6), pp. 452-457.

Hu et al., "Modulation of Gene Expression in the Eye with Antisense Oligonucleotides", Nucleic Acid Therapeutics, 2023, 33(6), pp. 339-347.

Garanto, "Antisense RNA Design, Delivery, and Analysis", Methods in Molecular Biology 2434, 2021, Chapter 22, pp. 321-332.

Vazquez-Dominguez et al., "Efficacy, biodistribution and safety comparison of chemically modified antisense oligonucleotides in the retina", Nucleic Acids Research, 2024, 52, pp. 10447-10463.

Advisory Action dated Oct. 16, 2024 in related U.S. Appl. No. 17/714,717.

Georgiadis et al. "Inhibitiors of ER Aminopeptidase 1 and 2: From Design to Clinical Application", Current Medicinal Chemistry, 2019, 26(15), pp. 2715-2729.

De Castro et al., "Molecular and pathogenic effects of endoplasmic reticulum aminopeptidases ERAP1 and ERAP2 in MHC-I-associated inflammatory disorders: Towards a unifying view", Molecular Immunology, 2016, 77, pp. 193-204.

Agrawal et al., "Genetic associations and functional characterization of M1 aminopeptidases and immune-mediated diseases", Genes and Immunity, 2014, 15(8), pp. 521-527.

Dimopoulou et al., "Variant in ERAP1 promoter region is associated with low expression in a patient with a Behcet-like MHC-I-opathy", Journal of Human Genetics, 2019, 65(3), pp. 325-335.

Babaie et al., "The roles of ERAP1 and ERAP2 in autoimmunity and cancer immunity: New insights and perspective", Molecular Immunology, 2020, 121, pp. 7-19.

(56) References Cited

OTHER PUBLICATIONS

Kuo et al., "Endoplasmic reticulum aminopeptidase 2 involvement in metastasis of oral cavity squamous cell carcinoma discovered by proteome profiling of primary cancer cells", Oncotarget, 2017, 8(37), pp. 61698-61708.

Final Office Action dated Aug. 2, 2024 in related U.S. Appl. No. 17/714,717.

Bousquet et al., "Birdshot Chorioretinopathy: A Review", Journal of Clinical Medicine, 2022, 11(4772), pp. 1-17.

Venema et al., "ERAP2 Increases the Abundance of a Peptide Submotif Highly Selective for the Birdshot Associated HLA-A29", Front Immunol, 2021, 12(634441), pp. 1-15.

* cited by examiner

| Second HLA-A Allele | UParis (A29 EUR Carriers) | | | | GHS cohort #1 (A29 EUR) | | | GHS cohort #2 (A29 EUR) | | | UKB (A29 EUR) | | |
|---|---|---|---|---|---|---|---|---|---|---|---|---|---|
| | Cases n=286 | Ctrls n=108 | OR (LCI-UCI) | p-val | Carriers n=4014 | OR (LCI-UCI) | p-val | Carriers n=2829 | OR (LCI-UCI) | p-val | Carriers n=38,543 | OR (LCI-UCI) | p-val |
| Aw19 co-susceptible (29,30,31,33) | 41 | 4 | 4.44 (1.55-17.53) | 2.20E-03 | 247 | 2.63 (1.80-3.78) | 1.29E-06 | 184 | 2.69 (1.81-3.92) | 1.07E-06 | 2416 | 2.51 (1.75-3.52) | 9.62E-07 |
| A3002 | 13 | 1 | 5.19 (0.76-222.84) | 0.12 | 45 | 4.31 (2.11-8.26) | 6.15E-05 | 20 | 6.60 (2.98-14.13) | 3.03E-06 | 396 | 4.60 (2.39-8.09) | 1.25E-05 |
| A3301 | 9 | 0 | Inf (0.77-Inf) | 0.07 | 39 | 3.40 (1.43-7.23) | 3.20E-03 | 32 | 2.80 (1.16-6.09) | 0.01 | 255 | 4.89 (2.19-9.56) | 1.63E-04 |
| A0301 | 26 | 15 | 0.63 (0.31-1.35) | 0.20 | 592 | 0.59 (0.38-0.90) | 0.01 | 380 | 0.63 (0.40-0.97) | 0.03 | 5497 | 0.60 (0.38-0.90) | 0.01 |
| A0101 | 71 | 17 | 1.81 (0.99-3.48) | 0.04 | 662 | 1.73 (1.29-2.31) | 2.67E-04 | 448 | 1.74 (1.28-2.33) | 3.21E-04 | 7411 | 1.39 (1.05-1.83) | 0.02 |
| A3201 | 3 | 4 | 0.28 (0.04-1.70) | 0.18 | 152 | 0.38 (0.06-0.80) | 0.01 | 105 | 0.37 (0.05-0.82) | 0.02 | 1323 | 0.30 (0.06-0.80) | 0.02 |
| A0201 | 64 | 24 | 1.03 (0.59-1.85) | 1.00 | 1085 | 0.80 (0.59-1.08) | 0.14 | 756 | 0.78 (0.57-1.04) | 0.09 | 10680 | 0.75 (0.56-1.00) | 0.05 |
| A2902 | 10 | 1 | 3.95 (0.55-173.12) | 0.30 | 48 | 3.07 (1.37-6.24) | 3.65E-03 | 37 | 2.70 (1.18-5.61) | 9.43E-03 | 750 | 1.83 (0.86-3.43) | 0.08 |
| A2601 | 8 | 3 | 1.03 (0.24-6.13) | 1.00 | 115 | 1.00 (0.42-2.07) | 1.00 | 91 | 0.85 (0.35-1.78) | 0.86 | 834 | 1.30 (0.55-2.62) | 0.41 |
| A2501 | 3 | 2 | 0.57 (0.06-6.96) | 0.62 | 101 | 0.42 (0.08-1.28) | 0.16 | 47 | 0.62 (0.12-1.94) | 0.62 | 673 | 0.60 (0.12-1.77) | 0.50 |
| A2402 | 23 | 11 | 0.79 (0.35-1.86) | 0.55 | 356 | 0.92 (0.57-1.44) | 0.83 | 249 | 0.89 (0.55-1.40) | 0.74 | 2801 | 1.12 (0.69-1.72) | 0.57 |
| A3101 | 9 | 2 | 1.75 (0.35-16.95) | 0.73 | 115 | 1.13 (0.50-2.26) | 0.71 | 75 | 1.18 (0.51-2.39) | 0.57 | 1015 | 1.20 (0.54-2.33) | 0.58 |
| A1101 | 14 | 10 | 0.52 (0.21-1.34) | 0.16 | 255 | 0.78 (0.41-1.36) | 0.44 | 177 | 0.76 (0.40-1.33) | 0.44 | 2278 | 0.82 (0.44-1.40) | 0.61 |
| A2301 | 6 | 2 | 1.16 (0.20-11.91) | 1.00 | 94 | 0.92 (0.33-2.10) | 1.00 | 61 | 0.96 (0.34-2.24) | 1.00 | 672 | 1.21 (0.44-2.68) | 0.65 |
| A6801 | 9 | 8 | 0.42 (0.14-1.27) | 0.09 | 128 | 1.01 (0.45-2.01) | 0.86 | 100 | 0.87 (0.38-1.76) | 0.87 | 1142 | 1.07 (0.48-2.06) | 0.86 |
| A19 all (29,30,31,32,33) | 44 | 8 | 2.07 (0.92-4.64) | 0.08 | 399 | 1.49 (1.02-2.18) | 0.04 | 269 | 1.58 (1.07-2.34) | 0.02 | 3739 | 1.51 (1.04-2.18) | 0.03 |

Figure 1

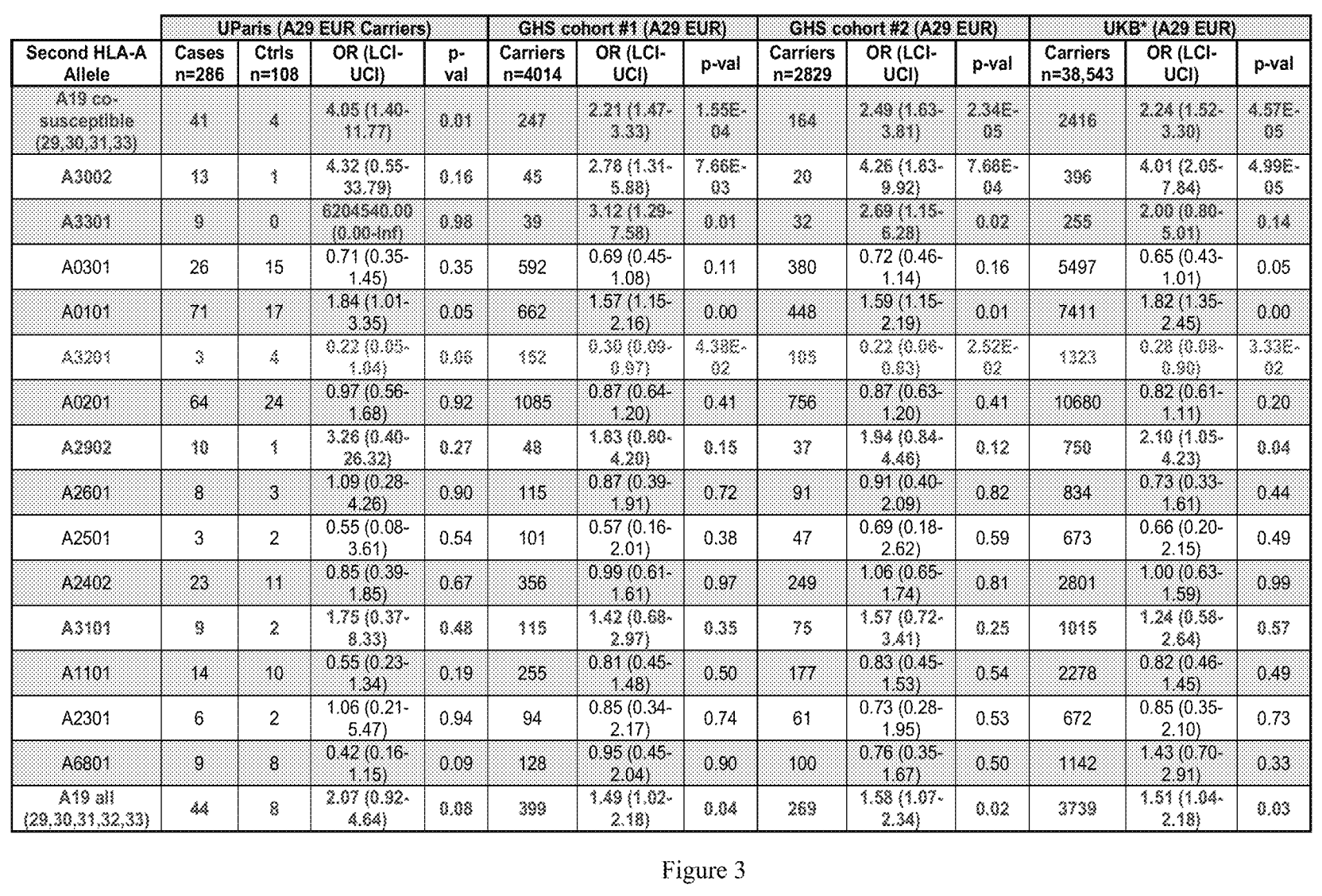

| Second HLA-A Allele | UParis (A29:EUR Carriers) | | | | GHS cohort #1 (A29:EUR) | | | GHS cohort #2 (A29:EUR) | | | UKB* (A29:EUR) | | |
|---|---|---|---|---|---|---|---|---|---|---|---|---|---|
| | Cases n=286 | Ctrls n=108 | OR (LCI-UCI) | p-val | Carriers n=4014 | OR (LCI-UCI) | p-val | Carriers n=2829 | OR (LCI-UCI) | p-val | Carriers n=38,543 | OR (LCI-UCI) | p-val |
| A19 co-susceptible (29,30,31,33) | 41 | 4 | 4.05 (1.40-11.77) | 0.01 | 247 | 2.21 (1.47-3.33) | 1.55E-04 | 164 | 2.49 (1.63-3.81) | 2.34E-05 | 2416 | 2.24 (1.52-3.30) | 4.57E-05 |
| A3002 | 13 | 1 | 4.32 (0.55-33.79) | 0.16 | 45 | 2.78 (1.31-5.88) | 7.66E-03 | 20 | 4.26 (1.83-9.92) | 7.68E-04 | 396 | 4.01 (2.05-7.84) | 4.99E-05 |
| A3301 | 9 | 0 | 8204548.00 (0.00-Inf) | 0.98 | 39 | 3.12 (1.29-7.58) | 0.01 | 32 | 2.69 (1.15-6.28) | 0.02 | 255 | 2.00 (0.80-5.01) | 0.14 |
| A0301 | 26 | 15 | 0.71 (0.35-1.45) | 0.35 | 592 | 0.69 (0.45-1.08) | 0.11 | 380 | 0.72 (0.46-1.14) | 0.16 | 5497 | 0.65 (0.43-1.01) | 0.05 |
| A0101 | 71 | 17 | 1.84 (1.01-3.35) | 0.05 | 662 | 1.57 (1.15-2.16) | 0.00 | 448 | 1.59 (1.15-2.19) | 0.01 | 7411 | 1.82 (1.35-2.45) | 0.00 |
| A3201 | 3 | 4 | 0.22 (0.05-1.04) | 0.06 | 152 | 0.30 (0.09-0.97) | 4.39E-02 | 105 | 0.22 (0.06-0.83) | 2.52E-02 | 1323 | 0.28 (0.09-0.90) | 3.33E-02 |
| A0201 | 64 | 24 | 0.97 (0.56-1.68) | 0.92 | 1085 | 0.87 (0.64-1.20) | 0.41 | 756 | 0.87 (0.63-1.20) | 0.41 | 10680 | 0.82 (0.61-1.11) | 0.20 |
| A2902 | 10 | 1 | 3.26 (0.40-26.32) | 0.27 | 48 | 1.63 (0.60-4.20) | 0.15 | 37 | 1.94 (0.84-4.46) | 0.12 | 750 | 2.10 (1.05-4.23) | 0.04 |
| A2601 | 8 | 3 | 1.09 (0.28-4.26) | 0.90 | 115 | 0.87 (0.39-1.91) | 0.72 | 91 | 0.91 (0.40-2.09) | 0.82 | 834 | 0.73 (0.33-1.61) | 0.44 |
| A2501 | 3 | 2 | 0.55 (0.08-3.61) | 0.54 | 101 | 0.57 (0.16-2.01) | 0.38 | 47 | 0.69 (0.18-2.62) | 0.59 | 673 | 0.66 (0.20-2.15) | 0.49 |
| A2402 | 23 | 11 | 0.85 (0.39-1.85) | 0.67 | 356 | 0.99 (0.61-1.61) | 0.97 | 249 | 1.06 (0.65-1.74) | 0.81 | 2801 | 1.00 (0.63-1.59) | 0.99 |
| A3101 | 9 | 2 | 1.75 (0.37-8.33) | 0.48 | 115 | 1.42 (0.68-2.97) | 0.35 | 75 | 1.57 (0.72-3.41) | 0.25 | 1015 | 1.24 (0.58-2.64) | 0.57 |
| A1101 | 14 | 10 | 0.55 (0.23-1.34) | 0.19 | 255 | 0.81 (0.45-1.48) | 0.50 | 177 | 0.83 (0.45-1.53) | 0.54 | 2278 | 0.82 (0.46-1.45) | 0.49 |
| A2301 | 6 | 2 | 1.06 (0.21-5.47) | 0.94 | 94 | 0.85 (0.34-2.17) | 0.74 | 61 | 0.73 (0.28-1.95) | 0.53 | 672 | 0.85 (0.35-2.10) | 0.73 |
| A6801 | 9 | 8 | 0.42 (0.16-1.15) | 0.09 | 128 | 0.95 (0.45-2.04) | 0.90 | 100 | 0.76 (0.35-1.67) | 0.50 | 1142 | 1.43 (0.70-2.91) | 0.33 |
| A19 all (29,30,31,32,33) | 44 | 8 | 2.07 (0.92-4.64) | 0.08 | 399 | 1.49 (1.02-2.18) | 0.04 | 269 | 1.58 (1.07-2.34) | 0.02 | 3739 | 1.51 (1.04-2.18) | 0.03 |

Figure 3

| ERAP1 | | | | | | | | | UParis | | | |
|---|---|---|---|---|---|---|---|---|---|---|---|---|
| rs27773968 5:96803892 G:A | rs3734016 5:96803761 C:T | rs26618 5:96795133 T:C | rs27895 5:96793840 C:T | rs2287987 5:96793827 T:C | rs30187 5:96788627 T:C | rs10050860 5:96786506 C:T | rs17482078 5:96783162 C:G | rs27044 5:96783148 C:G | F cases | F controls | OR | P |
| Function | | | | | | | | | | | | |
| I12T | E36K | I276M | G346D | M349V | K528R | D575N | R725Q | Q730E | | | | |
| Hap 1 T | E | I | G | M | K | D | R | Q | 0.17 | 0.35 | 0.41 | 6.7E-6 |
| Hap 2 T | E | I | G | M | K | D | R | Q | | | | |
| Hap 3 T | E | I | G | M | K | D | R | E | | | | |
| Hap 5 T | E | I | D | M | R | D | R | E | | | | |
| Hap 6 T | E | I | G | M | R | D | R | E | 0.55 | 0.48 | 1.32 | 0.11 |
| Hap 7 T | K | I | G | M | R | D | R | E | | | | |
| Hap 8 T | E | M | G | M | R | D | R | E | | | | |
| Hap 10 T | E | I | G | V | R | N | Q | E | 0.28 | 0.17 | 1.78 | 8.0E-3 |

Figure 4

| Gene | Variant | Variant type | Study | OR (LCI-UCI) | p-value | Hom OR | Case MAF | Control MAF | Meta OR (LCI-UCI) | Meta p-value |
|------|---------|--------------|-------|--------------|---------|--------|----------|-------------|-------------------|--------------|
| ERAP2-LNPEP | rs10044354 5:96984791:C:T | Intronic | Kuiper et al. | 2.3 (1.69-3.61) | 1.21E-06 | | 0.63 | 0.42 | 1.95 (1.55-2.44) | 6.20E-09 |
| | | | UParis | 1.55 (1.13-2.11) | 5.80E-03 | 2.6 (1.3-5.15) | 0.52 | 0.41 | | |
| | LD between rs10044354 (ERAP2-LNPEP) and rs27432 (ERAP1): D' = 0.79 R2 = 0.18 | | | | | | | | | |
| ERAP1 | rs27432 5:96783569:A:G* | Intronic | Kuiper et al. | 2.26 (2.05-2.47) | 7.20E-05 | | 0.85 | 0.71 | 2.46 (1.85-3.26) | 4.07E-10 |
| | | | UParis | 2.58 (1.78-3.76) | 6.60E-07 | 4.77 (1.98-11.51) | 0.83 | 0.65 | | |

Figure 5

| Gene | Variant | Variant type | Study | OR (LCI-UCI) | p-value | Hom OR | Case MAF | Control MAF | Meta OR (LCI-UCI) | Meta p-value |
|---|---|---|---|---|---|---|---|---|---|---|
| ERAP2 | rs2248374 5:96900192:A:G | Splice region | Kuiper et al. | 0.44 (0.31-0.63) | 6.60E-06 | | 0.33 | 0.53 | 0.56 (0.45-0.70) | 2.39E-07 |
| | | | UParis | 0.68 (0.5-0.92) | 1.40E-02 | 0.45 (0.23-0.87) | 0.43 | 0.53 | | |

Figure 6

| Aw19 | ERAP2-rs10044354 | case_n | contr_n | case_F | controlF | OR | OR CI_low | OR CI_high | P |
|---|---|---|---|---|---|---|---|---|---|
| A29/- | CC | 46 | 1296 | 0.167 | 0.319 | 1.000 | NA | NA | NA |
| A29/- | CT | 132 | 1842 | 0.478 | 0.453 | 2.019 | 1.421 | 2.911 | 3.95E-05 |
| A29/- | TT | 56 | 681 | 0.203 | 0.167 | 2.316 | 1.522 | 3.539 | 4.51E-05 |
| A29/Aw19 | CC | 13 | 94 | 0.047 | 0.023 | 3.891 | 1.861 | 7.644 | 2.13E-04 |
| A29/Aw19 | CT | 17 | 119 | 0.062 | 0.029 | 4.019 | 2.092 | 7.413 | 2.32E-05 |
| A29/Aw19 | TT | 12 | 34 | 0.043 | 0.008 | 9.902 | 4.378 | 21.197 | 1.16E-07 |

Figure 8

| Aw19 | ERAP1-rs27432 | cases number | controls number | cases freq. | controls freq. | OR | OR CI_low | OR CI_high | P |
|------|---------------|--------------|-----------------|-------------|----------------|-----|-----------|------------|---|
| A29/- | AA | 9 | 298 | 0.033 | 0.073 | 1.000 | NA | NA | NA |
| A29/- | AG | 58 | 1550 | 0.212 | 0.378 | 1.239 | 0.601 | 2.876 | 0.734 |
| A29/- | GG | 164 | 2001 | 0.601 | 0.488 | 2.713 | 1.374 | 6.105 | 1.72E-03 |
| A29/Aw19 | AA | 2 | 24 | 0.007 | 0.006 | 2.747 | 0.274 | 14.391 | 0.209 |
| A29/Aw19 | AG | 15 | 91 | 0.055 | 0.022 | 5.430 | 2.144 | 14.579 | 9.32E-05 |
| A29/Aw19 | GG | 25 | 133 | 0.092 | 0.032 | 6.196 | 2.708 | 15.515 | 1.54E-06 |

Figure 9

| ERAP1-rs27432 | ERAP2-rs10044354 | cases number | controls number | cases freq. | controls freq. | OR | OR_CIlo | OR_CIhi | P |
|---|---|---|---|---|---|---|---|---|---|
| AA | CC | 7 | 255 | 0.026 | 0.063 | 1.000 | NA | NA | NA |
| AA | CT | 4 | 60 | 0.015 | 0.015 | 2.420 | 0.503 | 9.885 | 0.236 |
| AA | TT | 0 | 2 | 0.000 | 0.000 | 0.000 | 0.000 | 208.116 | 1.000 |
| AG | CC | 19 | 687 | 0.070 | 0.170 | 1.007 | 0.400 | 2.871 | 1.000 |
| AG | CT | 49 | 856 | 0.180 | 0.212 | 2.084 | 0.924 | 5.521 | 0.072 |
| AG | TT | 5 | 86 | 0.018 | 0.021 | 2.113 | 0.515 | 7.964 | 0.197 |
| GG | CC | 32 | 443 | 0.118 | 0.109 | 2.628 | 1.118 | 7.160 | 0.024 |
| GG | CT | 94 | 1030 | 0.346 | 0.255 | 3.323 | 1.525 | 8.594 | 8.29E-04 |
| GG | TT | 62 | 627 | 0.228 | 0.155 | 3.598 | 1.617 | 9.446 | 4.03E-04 |

Figure 10

| Aw19 | ERAP1-rs27432 | ERAP2-rs10044354 | cases number | controls number | cases freq. | controls freq. | OR | OR_CIlo | OR_CIhi | P | Absolute risk |
|---|---|---|---|---|---|---|---|---|---|---|---|
| A29/- | 0 | 0 | 5 | 237 | 0.018 | 0.059 | NA | NA | NA | NA | 3.43E-05 |
| A29/- | 0/1 | 0/1 | 60 | 1510 | 0.220 | 0.373 | 1.883 | 0.752 | 6.071 | 0.197 | 6.45E-05 |
| A29/- | 2_either | 2_either | 113 | 1457 | 0.414 | 0.360 | 3.674 | 1.506 | 11.653 | 1.16E-03 | 1.26E-04 |
| A29/- | 2_both | 2_both | 53 | 596 | 0.194 | 0.147 | 4.211 | 1.666 | 13.665 | 6.26E-04 | 1.44E-04 |
| A29/Aw19 | 0 | 0 | 2 | 18 | 0.007 | 0.004 | 5.204 | 0.465 | 34.701 | 0.092 | 1.78E-04 |
| A29/Aw19 | 0/1 | 0/1 | 12 | 93 | 0.044 | 0.023 | 6.079 | 1.929 | 22.651 | 5.23E-04 | 2.08E-04 |
| A29/Aw19 | 2_either | 2_either | 19 | 104 | 0.070 | 0.026 | 8.604 | 3.002 | 30.314 | 3.09E-06 | 2.95E-04 |
| A29/Aw19 | 2_both | 2_both | 9 | 31 | 0.033 | 0.008 | 13.527 | 3.791 | 54.766 | 1.17E-05 | 4.63E-04 |

Figure 11

| Allele\position | 9 | 17 | 56 | 62 | 63 | 70 | 73 | 76 | 77 | 79 | 80 | 81 | 82 | 83 | 97 | 105 | 109 | 114 | 116 | 152 |
|---|---|---|---|---|---|---|---|---|---|---|---|---|---|---|---|---|---|---|---|---|
| | F | R | G | Q | E | H | T | A | N | G | T | L | R | G | I | P | F | R | D | A |
| A*01:01:01:01 | | | | | | Q | | | | | | | | | | | | | | |
| A*29:02:01:03 | T | ' | ' | L | Q | ' | ' | ' | ' | ' | ' | ' | ' | ' | M | S | ' | ' | ' | V |
| A*30:02:01:01 | S | S | R | ' | ' | ' | ' | E | ' | ' | ' | ' | ' | ' | ' | S | ' | E | H | R |
| A*31:01:02:01 | T | ' | R | ' | ' | ' | — | V | Q | R | ' | A | L | R | M | S | L | Q | ' | V |
| A*32:01:01:01 | ' | ' | ' | R | N | ' | ' | E | S | ' | ' | ' | ' | R | M | ' | ' | Q | ' | V |
| A*33:01:01:01 | T | ' | ' | ' | ' | ' | — | V | Q | ' | ' | ' | ' | ' | M | S | ' | Q | ' | V |
| A*74:01:01:01 | ' | ' | ' | ' | ' | ' | ' | V | D | ' | ' | ' | ' | ' | M | ' | L | Q | ' | V |

MODULATION OF ENDOPLASMIC RETICULUM AMINOPEPTIDASE 2 (ERAP2)-MEDIATED IMMUNE RESPONSE

REFERENCE TO SEQUENCE LISTING

This application includes a Sequence Listing filed electronically as a text file named 18923805101SEQ, created on Jul. 23, 2021, with a size of 1,243 kilobytes. The Sequence Listing is incorporated herein by reference.

FIELD

The present disclosure is directed, in part, to methods of treating subjects having an immune disorder by administering a therapeutically effective amount of an Endoplasmic Reticulum Aminopeptidase 2 (ERAP2) inhibitor to the subject, and optionally an Endoplasmic Reticulum Aminopeptidase 1 (ERAP1) agonist or inhibitor and/or an HLA-Aw19 inhibitor, and also provides methods of identifying subjects having an increased risk for developing an MHC-I-opathy.

BACKGROUND

The cellular immune response in humans relies at least partly on the presentation of small peptides that are 8 to 10 amino acids long, which are bound proteins of the major histocompatibility complex (MHC) (i.e., class I MHC molecules). These small peptides are derived from the proteolytic degradation of proteins (foreign antigens and self-antigens). One source of these antigens come from infected or malignantly transformed cells that express particular protein molecules that, upon degradation, yield distinct antigenic peptides that are presented on the cell surface complexed with MHC class I molecules (MHCl). Cytotoxic T cells can recognize these complexes of MHC molecules with degraded protein antigens and induce apoptotic cell death. Aberrant generation of antigenic peptides can lead to immune system evasion or to autoimmune reactions.

Although most antigenic peptides are initially produced by the proteasome, many of them are larger than the final antigenic epitope and contain one or more additional amino acids at their N-termini. These antigenic peptide precursors are transported into the endoplasmic reticulum (ER), where they are further degraded by at least two different amino-peptidases, ERAP1 and ERAP2, to generate the mature antigenic peptides for complexing with MHC class I molecules. Thus, the activity of ERAP1 and ERAP2 can directly affect the presentation of antigenic peptides complexed with particular MHC molecules in a beneficial or adverse manner, thus altering the immune response. Accordingly, there continues to be a need for identifying subjects that have particular MHC-I-opathies related to ERAP2 activity and treatment of the same.

Birdshot Chorioretinopathy (BSCR) is a rare autoimmune uveitis predominately affecting individuals over the age of 50 of European descent and treated with immunomodulatory therapies. The disease presents with vitritis and gradual decline in vision due to choroidal and retinal inflammatory lesions and atrophy. T cells have been identified in the retinal and choroidal tissues as well as the vitreous of affected BSCR eyes.

SUMMARY

The present disclosure provides methods of treating a subject having an immune disorder, the methods comprising administering to the subject a therapeutically effective amount of an ERAP2 inhibitor. Optionally, an ERAP1 agonist or inhibitor and/or an HLA-Aw19 inhibitor is also administered to the subject. The immune disorder can be an MHC-I-opathy or an MHC-II-opathy. The MHC-I-opathy can be BSCR, Ankylosing Spondylitis (AS), Behçet's disease, psoriasis, Juvenile Idiopathic Arthritis (JIA), inflammatory bowel disease (IBD), or Crohn's disease (CD).

The present disclosure also provides methods of treating a subject having an MHC-I-opathy, the methods comprising: performing or having performed an assay on a biological sample from the subject to determine whether the subject comprises: i) an MHC-I-opathy-related HLA genotype; and ii) a functional ERAP2 protein or a nucleic acid molecule encoding a functional ERAP2 protein; and administering to the subject a therapeutically effective amount of an ERAP2 inhibitor, wherein the subject comprises both an MHC-I-opathy-related HLA genotype and a functional ERAP2 protein or a nucleic acid molecule encoding a functional ERAP2 protein; wherein the presence of both the MHC-I-opathy-related HLA genotype and the functional ERAP2 protein or a nucleic acid molecule encoding a functional ERAP2 protein indicates that the subject is a candidate for treating the MHC-I-opathy by inhibiting ERAP2. The assay performed or having been performed on the biological sample from the subject can further determine whether the subject comprises a functional ERAP1 protein or a nucleic acid molecule encoding a functional ERAP1 protein; and the methods can further comprise administering to the subject a therapeutically effective amount of an ERAP1 agonist or inhibitor, wherein the subject comprises an MHC-I-opathy-related HLA genotype and does or does not comprise a functional ERAP1 protein or a nucleic acid molecule encoding a functional ERAP1 protein; wherein the presence of an MHC-I-opathy-related HLA genotype and the absence of a functional ERAP1 protein or a nucleic acid molecule encoding a functional ERAP1 protein indicates that the subject is a candidate for treating the MHC-I-opathy by activating ERAP1; wherein the presence of an MHC-I-opathy-related HLA genotype and the presence of a functional ERAP1 protein or a nucleic acid molecule encoding a functional ERAP1 protein indicates that the subject is a candidate for treating the MHC-I-opathy by inhibiting ERAP1.

The present disclosure also provides methods of identifying a subject having an increased risk for developing an MHC-I-opathy, the methods comprising: performing or having performed an assay on a biological sample from the subject to determine whether the subject comprises: i) an MHC-I-opathy-related HLA genotype; and ii) a functional ERAP2 protein or a nucleic acid molecule encoding a functional ERAP2 protein; wherein: when the subject has both the MHC-I-opathy-related HLA genotype and the functional ERAP2 protein or the nucleic acid molecule encoding the functional ERAP2 protein, then the subject has an increased risk of developing the MHC-I-opathy; when the subject lacks the MHC-I-opathy-related HLA genotype, or lacks the functional ERAP2 protein or the nucleic acid molecule encoding the functional ERAP2 protein, or lacks both, then the subject has a decreased risk of developing the MHC-I-opathy; and when the subject comprises two copies of the MHC-I-opathy-related HLA genotype, then the subject has an increased risk of developing the MHC-I-opathy compared to comprising a single copy of the MHC-I-opathy-related HLA genotype. The assay performed or having been performed on the biological sample from the subject can further determine whether the subject comprises a functional ERAP1 protein or a nucleic acid molecule encoding a functional ERAP1 protein. When the subject has the MHC-I-opathy-related HLA genotype and lacks the functional ERAP1 protein or the nucleic acid molecule encoding the functional ERAP1 protein, then the subject has an increased risk of developing the MHC-I-opathy; and when the subject lacks the MHC-I-opathy-related HLA genotype, or has the functional ERAP1 protein or the nucleic acid molecule encoding the functional ERAP1 protein, or both, then the subject has a decreased risk of developing the MHC-I-opathy.

BRIEF DESCRIPTION OF THE DRAWINGS

FIG. 1 shows a table of HLA-A 2nd allele frequencies in the French cohort compared to UKB and GHS EUR A29 carriers. Alleles belonging to the Aw19 broad antigen group that increase risk are A29, A30, A31 and A33 (red) and A32 exhibits protection (green). A Fisher's exact test combining all Aw19 risk alleles presents the strongest enrichment in all comparisons. Only alleles that have three or more case carriers are presented. Table is sorted by p-values when comparing case frequencies against A29 controls in UKB.

FIG. 3 shows a table of HLA-A 2nd allele frequencies in the French cohort compared to UKB and GHS EUR A29 carriers. Alleles belonging to the Aw19 broad antigen group that increase risk are A29, A30, A31 and A33 (red) and A32 exhibits protection (green). A logistic regression test with covariates included for sex and six principal components, calculated based on genetic array data for each analytic set. Results are presented for all HLA-A alleles that have three or more case carriers. Alleles are sorted as in FIG. 1. *Three principal components.

FIG. 4 shows a table of haplotype analysis of ERAP1. Haplotype analysis examining the association of all eight ERAP1 haplotypes with the case-control status, showing that Hap1 and Hap2 are strongly associated with protection from BSCR.

FIG. 5 shows a table of top SNPs in ERAP1 and ERAP2 regions. Variants in ERAP1 and ERAP2 are genome-wide significant when analyzed together with previous results (125 cases and 670 controls (Kuiper 2014). Rs10044354 is the top association in the ERAP1-ERAP2 locus in the previous GWAS of Dutch and Spanish cohorts, while rs27432 is the top association in the region in the current French cohort. The LD between the two loci is also presented. *The reference A-allele is the minor allele, risk is the G-allele.

FIG. 6 shows ERAP2 splice region variant is protective for BSCR. The common ERAP2 splice region variant rs2248374 that disrupts ERAP2 expression is protective in the current BSCR cohort and the previous Spanish and Dutch cohorts.

FIG. 8 shows a table of the combined risk of ERAP2 and Aw19. Utilizing 286 Birdshot cases and 4,014 controls from GHS cohort #1 to calculate additive risk while combining risk factors in ERAP2 and Aw19. An additive genotype model of ERAP2 risk signal tagged by rs10044354 and single (A29/-) or double (A29/Aw19) Aw19 copies relative to lowest risk combination of rs10044354-CC and one copy of Aw19 allele (A29).

FIG. 9 shows a table of the combined risk of ERAP1 and Aw19. Utilizing 286 Birdshot cases and 4,014 controls from GHS cohort #1 to calculate additive risk while combining risk factors in ERAP1 and Aw19. An additive genotype model of ERAP1 risk signal tagged by rs27432 and single (A29/-) or double (A29/Aw19) Aw19 copies relative to lowest risk combination of rs27432-AA and one copy of Aw19 allele (A29).

FIG. 10 shows a table of the combined risk of ERAP1 and ERAP2. Utilizing 286 Birdshot cases and 4,014 controls from GHS cohort #1 to calculate additive risk while combining risk factors in ERAP1 and ERAP2. An additive genotype model of ERAP1 risk signal tagged by rs27432 and ERAP2 signal tagged by rs10044354 relative to lowest risk combination of rs27432-AA and rs10044354-CC.

FIG. 11 shows a table of the combined risk of ERAP1, ERAP2 and Aw19. Utilizing 286 Birdshot cases and 4,014 controls from GHS cohort #1 to calculate additive risk while combining risk factors in ERAP1, ERAP2 and Aw19. An additive genotype model of ERAP1 and ERAP2 risk signals and single (A29/-) or double (A29/Aw19) Aw19 copies relative to lowest risk combination. The genotypes are combined as following: 0=ERAP1 and ERAP2 homozygous for protective allele. 1/[01],[01]/1=either homozygous protective or heterozygous genotypes of both ERAP1 and ERAP2. 2/ . . . /2=homozygous risk allele of either ERAP1 or ERAP2. 2/2=homozygous risk allele of both ERAP1 and ERAP2.

FIG. 12 shows differences between risk Aw19 alleles and A32. Panel A) Sequence differences between risk Aw19 alleles (red) and protective A32 allele (green). A32 exhibits F at position 9 as is the reference A:01:01 allele, while risk alleles are either T or S at that position. The Bw4 epitope sequence is apparent at positions 79-83 or A32 only.

DESCRIPTION OF EMBODIMENTS

Figure 2:
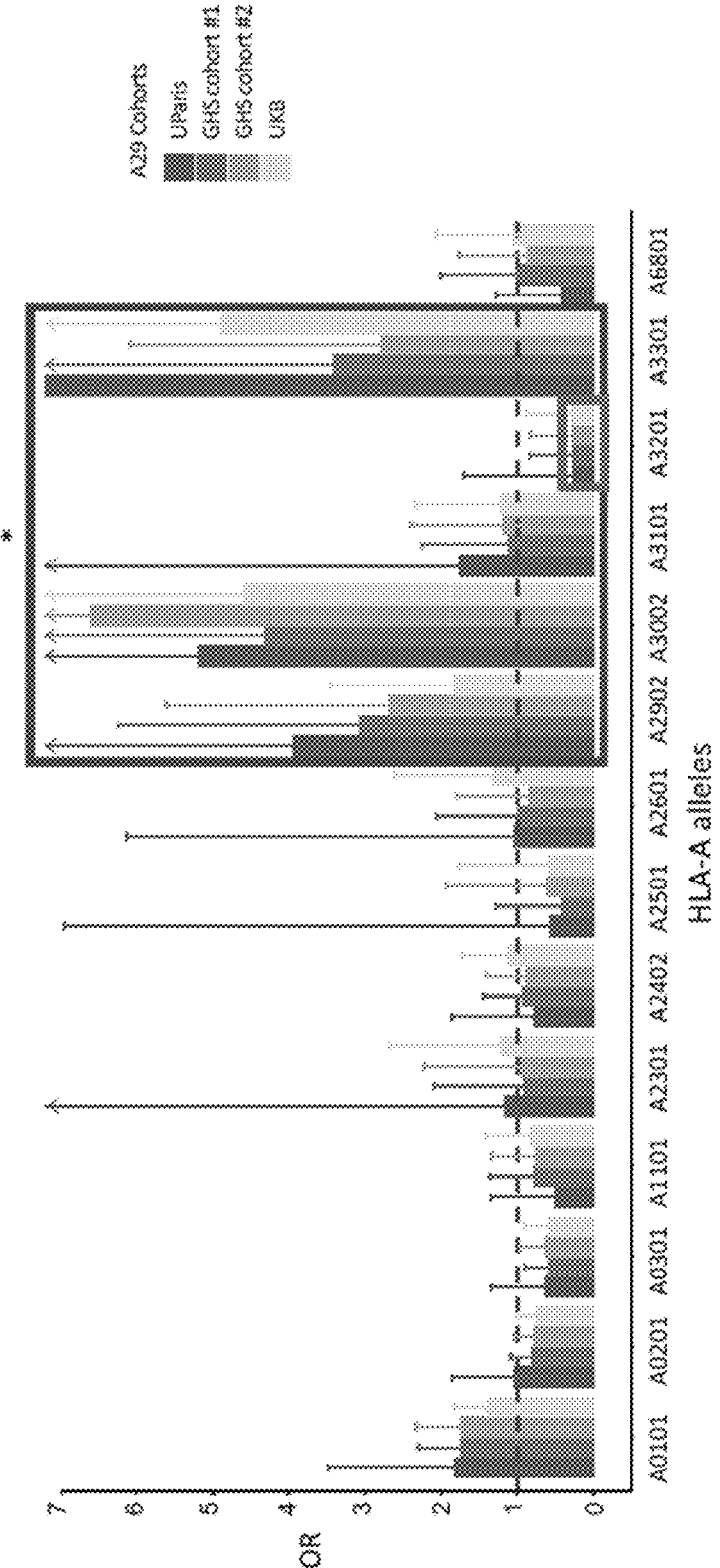
FIG. 2 shows Aw19 enrichment in Birdshot cases. Odds-ratio for BSCR, comparing frequencies of 14 HLA-A alleles that are present in three or more cases (>1%, x-axis) in 286 UParis cases compared with 108 UParis controls (Blue), GHS control cohort #1 (n=4,014, dark green), GHS control cohort #2 (n=2,829, bright green) and UKB controls (n=38, 543, yellow). Aw19 alleles show the highest ORs (red box) that replicates with large A29 control cohorts, with the exception of A32 that is depleted in cases (green box). * p<0.01

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates (such as, for example, apes and monkeys). In some embodiments, the subject is a human. In some embodiments, the subject is a patient under the care of a physician.

The present disclosure provides methods of treating a subject having an immune disorder, the methods comprising administering to the subject an ERAP2 inhibitor. In some embodiments, the immune disorder is an MHC-I-opathy. In some embodiments, the immune disorder is an MHC-II-opathy. In some embodiments, the MHC-I-opathy is Birdshot Chorioretinopathy (BSCR), Ankylosing Spondylitis (AS), Behçet's disease, psoriasis, Juvenile Idiopathic Arthritis (JIA), inflammatory bowel disease (IBD), or Crohn's disease (CD). In some embodiments, the MHC-I-opathy is BSCR. In some embodiments, the MHC-I-opathy is AS. In some embodiments, the MHC-I-opathy is Behçet's disease. In some embodiments, the MHC-I-opathy is psoriasis. In some embodiments, the MHC-I-opathy is JIA. In some embodiments, the MHC-I-opathy is IBD. In some embodiments, the MHC-I-opathy is CD.

In some embodiments, the MHC-I-opathy is BSCR. In some embodiments, the method further comprises detecting the presence or absence of an HLA-Aw19 allele in a biological sample obtained from the subject. In some embodiments, the subject is HLA-Aw19$^+$. In some embodiments, the subject is or is suspected of being HLA-A*29$^+$, HLA-A*30$^+$, HLA-A*31$^+$, or HLA-A*33$^+$, or any combination thereof. In some embodiments, the method further comprises determining whether the subject has one or two copies of an HLA-Aw19 allele. In some embodiments, the subject has a single copy of HLA-Aw19. In some embodiments, the subject has two copies of HLA-Aw19. In some embodiments, the subject is HLA-A*29$^+$/HLA-A*30$^+$. In some embodiments, the subject is HLA-A*29$^+$/HLA-A*31$^+$. In some embodiments, the subject is HLA-A*29$^+$/HLA-A*33$^+$.

In some embodiments, the subject having BSCR is not HLA-A*29$^+$.

In some embodiments, the subject having BSCR has a copy of at least any two of HLA-A*29, HLA-A*30, HLA-A*31, or HLA-A*33. In some embodiments, the subject having BSCR has a copy of at least any three of HLA-A*29, HLA-A*30, HLA-A*31, or HLA-A*33. In some embodiments, the subject having BSCR has a copy of all of HLA-A*29, HLA-A*30, HLA-A*31, or HLA-A*33.

In some embodiments, the subject having BSCR has one copy of each HLA-A*29 and HLA-A*30. In some embodiments, the subject having BSCR has one copy of each HLA-A*29 and HLA-A*31. In some embodiments, the subject having BSCR has one copy of each HLA-A*29 and HLA-A*33. In some embodiments, the subject having BSCR has one copy of each HLA-A*30 and HLA-A*31. In some embodiments, the subject having BSCR has one copy of each HLA-A*30 and HLA-A*33. In some embodiments, the subject having BSCR has one copy of each HLA-A*31 and HLA-A*33.

In some embodiments, the subject having BSCR has one copy of HLA-A*29 and two copies of HLA-A*30. In some embodiments, the subject having BSCR has one copy of HLA-A*29 and two copies of HLA-A*31. In some embodiments, the subject having BSCR has one copy of HLA-A*29 and two copies of HLA-A*33. In some embodiments, the subject having BSCR has one copy of HLA-A*30 and two copies of HLA-A*31. In some embodiments, the subject having BSCR has one copy of HLA-A*30 and two copies HLA-A*33. In some embodiments, the subject having BSCR has one copy of HLA-A*31 and two copies of HLA-A*33.

In some embodiments, the subject having BSCR has two copies of HLA-A*29 and one copy of HLA-A*30. In some embodiments, the subject having BSCR has two copies of HLA-A*29 and one copy of HLA-A*31. In some embodiments, the subject having BSCR has two copies of HLA-A*29 and one copy of HLA-A*33. In some embodiments, the subject having BSCR has two copies of HLA-A*30 and one copy of HLA-A*31. In some embodiments, the subject having BSCR has two copies of HLA-A*30 and one copy of HLA-A*33. In some embodiments, the subject having BSCR has two copies of HLA-A*31 and one copy of HLA-A*33.

In some embodiments, the subject having BSCR or suspected of having BSCR has two copies of HLA-A*29 and two copies of HLA-A*30. In some embodiments, the subject having BSCR or suspected of having BSCR has two copies of HLA-A*29 and two copies of HLA-A*31. In some embodiments, the subject having BSCR or suspected of having BSCR has two copies of HLA-A*29 and two copies of HLA-A*33. In some embodiments, the subject having BSCR or suspected of having BSCR has two copies of HLA-A*30 and two copies of HLA-A*31. In some embodiments, the subject having BSCR or suspected of having BSCR has two copies of HLA-A*30 and two copies of HLA-A*33. In some embodiments, the subject having BSCR or suspected of having BSCR has two copies of HLA-A*31 and two copies of HLA-A*33.

In some embodiments, the method further comprises administering to the subject an HLA-Aw19 inhibitor. In some embodiments, the HLA-Aw19 inhibitor is an antibody. In some embodiments, the antibody is an anti-HLA-A*29 antibody. In some embodiments, the HLA-Aw19 inhibitor comprises a small molecule degrader or an inhibitory nucleic acid molecule. In some embodiments, the inhibitory nucleic acid molecule is an antisense nucleic acid molecule, a small interfering RNA (siRNA), or a short hairpin RNA (shRNA) that hybridizes to an HLA-Aw19. In some embodiments, the HLA-Aw19 is HLA-A*29.

In some embodiments, the MHC-I-opathy is AS. In some embodiments, the method further comprises detecting the presence or absence of HLA-B*27 or HLA-B*40 in a biological sample obtained from the subject. In some embodiments, the subject is or is suspected of being HLA-B*27$^+$. In some embodiments, the subject is or is suspected of being HLA-B*40$^+$. In some embodiments, the method further comprises determining whether the subject has one or two copies of HLA-B*27 or HLA-B*40. In some embodiments, the subject has a single copy of HLA-B*27 or HLA-B*40. In some embodiments, the subject has two copies of HLA-B*27 or HLA-B*40. In some embodiments, the method further comprises administering to the subject an HLA-B*27 inhibitor or an HLA-B*40 inhibitor. In some embodiments, the HLA-B*27 inhibitor or HLA-B*40 inhibitor is an antibody. In some embodiments, the antibody is an anti-HLA-B*27 antibody or an anti-HLA-B*40 antibody. In some embodiments, the HLA-B*27 inhibitor or HLA-B*40 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*27 or an HLA-B*40.

In some embodiments, the MHC-I-opathy is Behçet's disease. In some embodiments, the method further comprises detecting the presence or absence of HLA-B*51 in a biological sample obtained from the subject. In some embodiments, the subject is or is suspected of being HLA-B*51$^+$. In some embodiments, the method further comprises determining whether the subject has one or two copies of HLA-B*51. In some embodiments, the subject has a single copy of HLA-B*51. In some embodiments, the subject has two copies of HLA-B*51. In some embodiments, the method further comprises administering to the subject an HLA-B*51 inhibitor. In some embodiments, the HLA-B*51 inhibitor is an antibody. In some embodiments, the antibody is an anti-HLA-B*51 antibody. In some embodiments, the HLA-B*51 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*51.

In some embodiments, the MHC-I-opathy is psoriasis. In some embodiments, the method further comprises detecting the presence or absence of HLA-C*06 in a biological sample obtained from the subject. In some embodiments, the subject is or is suspected of being HLA-C*06$^+$. In some embodiments, the method further comprises determining whether the subject has one or two copies of HLA-C*06. In some embodiments, the subject has a single copy of HLA-C*06. In some embodiments, the subject has two copies of HLA-C*06. In some embodiments, the method further comprises administering to the subject an HLA-C*06 inhibitor. In some embodiments, the HLA-C*06 inhibitor is an antibody. In some embodiments, the antibody is an anti-HLA-C*06 antibody. In some embodiments, the HLA-C*06 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-C*06.

In some embodiments, the MHC-I-opathy is JIA. In some embodiments, the method further comprises detecting the presence or absence of HLA-B*27 and/or DRB1 in a biological sample obtained from the subject. In some embodiments, the subject is or is suspected of being HLA-B*27$^+$ and/or DRB1$^+$. In some embodiments, the method further comprises determining whether the subject has one or two copies of HLA-B*27 and/or DRB1. In some embodiments, the subject has a single copy of HLA-B*27 and/or DRB1. In some embodiments, the subject has two copies of HLA-B*27 and/or DRB1. In some embodiments, the method further comprises administering to the subject an HLA-B*27 inhibitor and/or a DRB1 inhibitor. In some embodiments, the HLA-B*27 inhibitor and/or DRB1 inhibitor is an antibody. In some embodiments, the antibody is an anti-HLA-B*27 antibody or an anti-DRB1 antibody. In some embodiments, the HLA-B*27 inhibitor and/or DRB1 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*27 and/or an DRB1.

In some embodiments, the MHC-I-opathy is IBD or CD. In some embodiments, the method further comprises detecting the presence or absence of HLA-C*07 in a biological sample obtained from the subject. In some embodiments, the subject is or is suspected of being HLA-C*07$^+$. In some embodiments, the method further comprises determining whether the subject has one or two copies of HLA-C*07. In some embodiments, the subject has a single copy of HLA-C*07. In some embodiments, the subject has two copies of HLA-C*07. In some embodiments, the method further comprises administering to the subject an HLA-C*07 inhibitor. In some embodiments, the HLA-C*07 inhibitor is an antibody. In some embodiments, the antibody is an anti-HLA-C*07 antibody. In some embodiments, the HLA-C*07 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-C*07.

In some embodiments, the ERAP2 inhibitor comprises a small molecule degrader, a proteoloysis-targeting chimera, an immunomodulatory drug, or an inhibitory nucleic acid molecule. In some embodiments, the inhibitory nucleic acid molecule is an antisense nucleic acid molecule, an siRNA, or an shRNA that hybridizes to ERAP2 mRNA. In some embodiments, the inhibitory nucleic acid molecule is an antisense nucleic acid molecule that hybridizes to ERAP2 mRNA. In some embodiments, the inhibitory nucleic acid molecule is an siRNA that hybridizes to ERAP2 mRNA. In some embodiments, the inhibitory nucleic acid molecule is an shRNA that hybridizes to ERAP2 mRNA. In some embodiments, the ERAP2 inhibitor comprises an anti-ERAP2 antibody. In some embodiments, the ERAP2 inhibitor comprises a pseudopeptide. In some embodiments, the pseudopeptide is a phosphinic pseudopeptide. In some embodiments, the phosphinic pseudopeptide is DG002 or DG013 (see, for example, Zervoudi et al., Proc. Natl. Acad. Sci. USA, 2013, 110, 19890-19895). In some embodiments, the phosphinic pseudopeptide is DG002. In some embodiments, the phosphinic pseudopeptide is DG013. In some embodiments, the ERAP2 inhibitor comprises a small molecule. In some embodiments, the ERAP2 inhibitor is compound 4, compound 15, compound 16, compound 5, or analogues of compound 5, which are drug-like carboxylic acids and bioisosters screened for enhanced selectivity for ERAP2 over ERAP1 (see, Medve et al., European Journal of Medicinal Chemistry, 2021, 211, 113053). In some embodiments, the ERAP2 inhibitor is a phosphonic or phosphinic acid compound with higher affinity for ERAP2 than ERAP1 (see, Weglarz-Tomczak et al., Bioorg. Med. Chem. Lett., 2016, 26, 4122-4126). Additional ERAP2 inhibitors are described in, for example, Georgiadis et al., Curr. Medic. Chem., 2019, 26, 2715-2729.

In any of the embodiments described herein, the methods can further comprise administering to the subject an ERAP1 agonist or inhibitor, depending upon the MHC-I-opathy. For AS and psoriasis, an ERAP1 inhibitor can be administered. For the remaining MHC-I-opathies, an ERAP1 agonist can be administered.

In some embodiments, the ERAP1 agonist comprises an oligonucleotide. In some embodiments, the oligonucleotide is ODN1826. In some embodiments, the ERAP1 agonist comprises a peptide. In some embodiments, the ERAP1 agonist comprises a lipopeptide. In some embodiments, the lipopeptide is Pam3CSK4 or FSL-1. In some embodiments, the lipopeptide is Pam3CSK4. In some embodiments, the lipopeptide is FSL-1. In some embodiments, the ERAP1 agonist comprises a small molecule. In some embodiments, the ERAP1 agonist can comprise an ERAP1-specific transcriptional activator, an ERAP1 protein stabilizer, an agonist of ERAP1 enzymatic activity, or an activator of ERAP1 secretion. In some embodiments, the ERAP1 agonist can comprise an ERAP1-specific transcriptional activator. In some embodiments, the ERAP1 agonist can comprise an ERAP1 protein stabilizer. In some embodiments, the ERAP1 agonist can comprise an agonist of ERAP1 enzymatic activity. In some embodiments, the ERAP1 agonist can comprise an activator of ERAP1 secretion. Additional examples of ERAP1 agonists are described in, for example, Goto et al., J. Immunol., 2014, 192, 4443-4452.

In some embodiments, the ERAP1 inhibitor comprises a small molecule degrader, a proteoloysis-targeting chimera, an immunomodulatory drug, or an inhibitory nucleic acid molecule. In some embodiments, the inhibitory nucleic acid molecule is an antisense nucleic acid molecule, an siRNA, or an shRNA that hybridizes to ERAP1 mRNA. In some embodiments, the inhibitory nucleic acid molecule is an antisense nucleic acid molecule that hybridizes to ERAP1 mRNA. In some embodiments, the inhibitory nucleic acid molecule is an siRNA that hybridizes to ERAP1 mRNA. In some embodiments, the inhibitory nucleic acid molecule is an shRNA that hybridizes to ERAP1 mRNA. In some embodiments, the ERAP1 inhibitor comprises an anti-ERAP1 antibody. In some embodiments, the ERAP1 inhibitor is DG002 and DG013 (see, Zervoudi et al., Proc. Nat'l Acad. Sci. USA, 2013, 110, 19890-19895). In some embodiments, the ERAP1 inhibitor is a phosphinic dipeptide or tripeptide analog (see, Weglarz-Tomczak et al., Bioorg. Med. Che, Lett., 2016, 26, 4122-4126). In some embodiments, the ERAP1 inhibitor is (N—(N-(2-(1H-indol-3-yl) ethyl)carbamimidoyl)-2,5-difluorobenzenesulfonamide), (1-(1-(4-acetylpiperazine-1-carbonyl)cyclohexyl)-3-(p-tolyl) urea), or (4-methoxy-3-(N-(2-(piperidin-1-yl)-5-(trifluoromethyl)phenyl) sulfamoyl)benzoic acid (see, Maben et al., J. Med. Chem., 2020, 63, 103-121). In some embodiments, the ERAP1 inhibitor is (4aR,5S,6R,8S,8aR)-5-(2-(Furan-3-yl)ethyl)-8-hydroxy-5,6,8a-trimethyl-3,4,4a, 5,6,7,8,8a-octahydronaphthalene-1-carboxylic acid (see, Liddle et al., J. Med. Chem., 2020, 63, 3348-3358). In some embodiments, the ERAP1 inhibitor is DG013A or a phosphinic tripeptide or dipeptide or an aminophosphonic derivative, or 3,4-diaminobenzoic (DABA) derivative, or a derivative of thimerosal, (see, Georgiadis et al., Cur. Med. Chem., 2019, 26, 2715-2729). In some embodiments, the ERAP1 inhibitor is a benzofuran or 7-Benzofuran amide variation (see, Deddouche-Grass et al., ACS Med. Chem. Lett., 2021, 12, 1137-1142).

In any of the embodiments described herein, any of the inhibitors or other agents described herein can form a component of an antibody-drug-conjugate (ADC). For example, an ERAP1 inhibitor or an ERAP2 inhibitor can be conjugated to an antibody, or antigen-binding fragment thereof. The inhibitor can comprise a small molecule degrader, a proteoloysis-targeting chimera, an immunomodulatory drug, or an inhibitory nucleic acid molecule.

The present disclosure also provides methods of treating a subject having an MHC-I-opathy. In some embodiments, the method comprises performing or having performed an assay on a biological sample from the subject to determine whether the subject comprises: i) an MHC-I-opathy-related HLA genotype; and ii) a functional ERAP2 protein or a nucleic acid molecule encoding a functional ERAP2 protein. In some embodiments, the method comprises administering to the subject a therapeutically effective amount of an ERAP2 inhibitor, wherein the subject comprises both an MHC-I-opathy-related HLA genotype and a functional ERAP2 protein or a nucleic acid molecule encoding a functional ERAP2 protein. The presence of both the MHC-I-opathy-related HLA genotype and the functional ERAP2 protein or a nucleic acid molecule encoding a functional ERAP2 protein indicates that the subject is a candidate for treating the MHC-I-opathy by inhibiting ERAP2.

In some embodiments, the MHC-I-opathy is BSCR and the MHC-I-opathy-related HLA genotype comprises an HLA-Aw19 allele. In some embodiments, the HLA-Aw19 allele is an HLA-A*29 allele, an HLA-A*30 allele, an HLA-A*31 allele, or an HLA-A*33 allele, or any combination thereof. In some embodiments, the subject has a single copy of the HLA-Aw19 allele. In some embodiments, the HLA-Aw19 allele is an HLA-A*29 allele. In some embodiments, the HLA-Aw19 allele is an HLA-A*30 allele. In some embodiments, the HLA-Aw19 allele is an HLA-A*31 allele. In some embodiments, the HLA-Aw19 allele is an HLA-A*33 allele. In some embodiments, the subject has two copies of the HLA-Aw19 allele. In some embodiments, the subject is or is suspected of being HLA-A*29$^+$/HLA-A*30$^+$. In some embodiments, the subject is or is suspected of being HLA-A*29$^+$/HLA-A*31$^+$. In some embodiments, the subject is or is suspected of being HLA-A*29$^+$/HLA-A*33$^+$.

In some embodiments, the subject having BSCR is not HLA-A*29$^+$.

In some embodiments, the subject having BSCR has a copy of at least any two of HLA-A*29, HLA-A*30, HLA-A*31, or HLA-A*33. In some embodiments, the subject having BSCR has a copy of at least any three of HLA-A*29, HLA-A*30, HLA-A*31, or HLA-A*33. In some embodiments, the subject having BSCR has a copy of all of HLA-A*29, HLA-A*30, HLA-A*31, or HLA-A*33.

In some embodiments, the subject having BSCR has one copy of each HLA-A*29 and HLA-A*30. In some embodiments, the subject having BSCR has one copy of each HLA-A*29 and HLA-A*31. In some embodiments, the subject having BSCR has one copy of each HLA-A*29 and HLA-A*33. In some embodiments, the subject having BSCR has one copy of each HLA-A*30 and HLA-A*31. In some embodiments, the subject having BSCR has one copy of each HLA-A*30 and HLA-A*33. In some embodiments, the subject having BSCR has one copy of each HLA-A*31 and HLA-A*33.

In some embodiments, the subject having BSCR has one copy of HLA-A*29 and two copies of HLA-A*30. In some embodiments, the subject having BSCR has one copy of HLA-A*29 and two copies of HLA-A*31. In some embodiments, the subject having BSCR has one copy of HLA-A*29 and two copies of HLA-A*33. In some embodiments, the subject having BSCR has one copy of HLA-A*30 and two copies of HLA-A*31. In some embodiments, the subject having BSCR has one copy of HLA-A*30 and two copies HLA-A*33. In some embodiments, the subject having BSCR has one copy of HLA-A*31 and two copies of HLA-A*33.

In some embodiments, the subject having BSCR has two copies of HLA-A*29 and one copy of HLA-A*30. In some embodiments, the subject having BSCR has two copies of HLA-A*29 and one copy of HLA-A*31. In some embodiments, the subject having BSCR has two copies of HLA-A*29 and one copy of HLA-A*33. In some embodiments, the subject having BSCR has two copies of HLA-A*30 and one copy of HLA-A*31. In some embodiments, the subject having BSCR has two copies of HLA-A*30 and one copy of HLA-A*33. In some embodiments, the subject having BSCR has two copies of HLA-A*31 and one copy of HLA-A*33.

In some embodiments, the subject having BSCR or suspected of having BSCR has two copies of HLA-A*29 and two copies of HLA-A*30. In some embodiments, the subject having BSCR or suspected of having BSCR has two copies of HLA-A*29 and two copies of HLA-A*31. In some embodiments, the subject having BSCR or suspected of having BSCR has two copies of HLA-A*29 and two copies of HLA-A*33. In some embodiments, the subject having BSCR or suspected of having BSCR has two copies of HLA-A*30 and two copies of HLA-A*31. In some embodiments, the subject having BSCR or suspected of having BSCR has two copies of HLA-A*30 and two copies of HLA-A*33. In some embodiments, the subject having BSCR or suspected of having BSCR has two copies of HLA-A*31 and two copies of HLA-A*33.

In some embodiments, the method further comprises administering to the subject an HLA-Aw19 inhibitor. In some embodiments, the HLA-Aw19 inhibitor is an antibody. In some embodiments, the antibody is an anti-HLA-A*29 antibody. In some embodiments, the HLA-Aw19 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-Aw19. In some embodiments, the HLA-Aw19 is HLA-A*29.

In some embodiments, the MHC-I-opathy is AS and the MHC-I-opathy-related HLA genotype comprises an HLA-B*27 allele or an HLA-B*40 allele. In some embodiments, the subject has a single copy of HLA-B*27 or HLA-B*40. In some embodiments, the subject has two copies of HLA-B*27 or HLA-B*40. In some embodiments, the method further comprises administering to the subject an HLA-B*27 inhibitor or an HLA-B*40 inhibitor. In some embodiments, the HLA-B*27 inhibitor or HLA-B*40 inhibitor is an antibody. In some embodiments, the antibody is an anti-HLA-B*27 antibody or an anti-HLA-B*40 antibody. In some embodiments, the HLA-B*27 inhibitor or HLA-B*40 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*27 or an HLA-B*40.

In some embodiments, the MHC-I-opathy is Behçet's disease and the MHC-I-opathy-related HLA genotype comprises an HLA-B*51 allele. In some embodiments, the subject has a single copy of HLA-B*51. In some embodiments, the subject has two copies of HLA-B*51. In some embodiments, the method further comprises administering to the subject an HLA-B*51 inhibitor. In some embodiments, the HLA-B*51 inhibitor is an antibody. In some embodiments, the antibody is an anti-HLA-B*51 antibody. In some embodiments, the HLA-B*51 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*51.

In some embodiments, the MHC-I-opathy is psoriasis and the MHC-I-opathy-related HLA genotype comprises an HLA-C*06 allele. In some embodiments, the subject has a single copy of HLA-C*06. In some embodiments, the subject has two copies of HLA-C*06. In some embodiments, the method further comprises administering to the subject an HLA-C*06 inhibitor. In some embodiments, the HLA-C*06 inhibitor is an antibody. In some embodiments, the antibody is an anti-HLA-C*06 antibody. In some embodiments, the HLA-C*06 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-C*06.

In some embodiments, the MHC-I-opathy is JIA and the MHC-I-opathy-related HLA genotype comprises an HLA-B*27 and/or DRB1. In some embodiments, the subject has a single copy of HLA-B*27 and/or DRB1. In some embodiments, the subject has two copies of HLA-B*27 and/or. In some embodiments, the method further comprises administering to the subject an HLA-B*27 inhibitor and/or a DRB1 inhibitor. In some embodiments, the HLA-B*27 inhibitor and/or DRB1 inhibitor is an antibody. In some embodiments, the antibody is an anti-HLA-B*27 antibody and/or a DRB1 antibody. In some embodiments, the HLA-B*27 inhibitor and/or DRB1 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*27 or DRB1.

In some embodiments, the MHC-I-opathy is IBD or CD and the MHC-I-opathy-related HLA genotype comprises an HLA-C*07 allele. In some embodiments, the subject has a single copy of HLA-C*07. In some embodiments, the subject has two copies of HLA-C*07. In some embodiments, the method further comprising administering to the subject an HLA-C*07 inhibitor. In some embodiments, the HLA-C*07 inhibitor is an antibody. In some embodiments, the antibody is an anti-HLA-C*07 antibody. In some embodiments, the HLA-C*07 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-C*07.

In any of the embodiments described herein, the nucleic acid molecule comprises genomic DNA, mRNA, or cDNA obtained from mRNA. In some embodiments, the nucleic acid molecule comprises genomic DNA. In some embodiments, the nucleic acid molecule comprises mRNA. In some embodiments, the nucleic acid molecule comprises cDNA obtained from mRNA.

In any of the embodiments described herein, the ERAP2 inhibitor comprises a small molecule degrader, a proteoloy-sis-targeting chimera, an immunomodulatory drug, or an inhibitory nucleic acid molecule. In some embodiments, the inhibitory nucleic acid molecule is an antisense nucleic acid molecule, an siRNA, or an shRNA that hybridizes to ERAP2 mRNA. In some embodiments, the inhibitory nucleic acid molecule is an antisense nucleic acid molecule that hybrid-izes to ERAP2 mRNA. In some embodiments, the inhibitory nucleic acid molecule is an siRNA that hybridizes to ERAP2 mRNA. In some embodiments, the inhibitory nucleic acid molecule is an shRNA that hybridizes to ERAP2 mRNA. In some embodiments, the ERAP2 inhibitor comprises an anti-ERAP2 antibody. In some embodiments, the ERAP2 inhibitor comprises a pseudopeptide. In some embodiments, the pseudopeptide is a phosphinic pseudopeptide. In some embodiments, the phosphinic pseudopeptide is DG002 or DG013. In some embodiments, the ERAP2 inhibitor com-prises a small molecule.

In any of the embodiments described herein, the assay performed or having been performed on the biological sample from the subject can further determine whether the subject comprises a functional ERAP1 protein or a nucleic acid molecule encoding a functional ERAP1 protein. In some embodiments, the method further comprises adminis-tering to the subject a therapeutically effective amount of an ERAP1 agonist or inhibitor (depending upon the MHC-I-opathy), wherein the subject comprises an MHC-I-opathy-related HLA genotype and does or does not comprise a functional ERAP1 protein or a nucleic acid molecule encod-ing a functional ERAP1 protein. The presence of an MHC-I-opathy-related HLA genotype and the absence of a func-tional ERAP1 protein or a nucleic acid molecule encoding a functional ERAP1 protein indicates that the subject is a candidate for treating the MHC-I-opathy by activating ERAP1. The presence of an MHC-I-opathy-related HLA genotype and the presence of a functional ERAP1 protein or a nucleic acid molecule encoding a functional ERAP1 protein indicates that the subject is a candidate for treating the MHC-I-opathy by inhibiting ERAP1.

In any of the embodiments described herein, the ERAP1 agonist comprises an oligonucleotide. In some embodi-ments, the oligonucleotide is ODN1826. In some embodi-ments, the ERAP1 agonist comprises a peptide. In some embodiments, the ERAP1 agonist comprises a lipopeptide. In some embodiments, the lipopeptide is Pam3CSK4 or FSL-1. In some embodiments, the lipopeptide is Pam3CSK4. In some embodiments, the lipopeptide is FSL-1. In some embodiments, the ERAP1 agonist comprises a small molecule. In some embodiments, the ERAP1 agonist can comprise an ERAP1-specific transcriptional activator, an ERAP1 protein stabilizer, an agonist of ERAP1 enzy-matic activity, or an activator of ERAP1 secretion. In some embodiments, the ERAP1 agonist can comprise an ERAP1-specific transcriptional activator. In some embodiments, the ERAP1 agonist can comprise an ERAP1 protein stabilizer. In some embodiments, the ERAP1 agonist can comprise an agonist of ERAP1 enzymatic activity. In some embodi-ments, the ERAP1 agonist can comprise an activator of ERAP1 secretion. Additional examples of ERAP1 agonists are described in, for example, Goto et al., J. Immunol., 2014, 192, 4443-4452.

In any of the embodiments described herein, the ERAP1 inhibitor comprises a small molecule degrader, a proteoloysis-targeting chimera, an immunomodulatory drug, or an inhibitory nucleic acid molecule. In some embodiments, the inhibitory nucleic acid molecule is an antisense nucleic acid molecule, an siRNA, or an shRNA that hybridizes to ERAP1 mRNA. In some embodiments, the inhibitory nucleic acid molecule is an antisense nucleic acid molecule that hybrid-izes to ERAP1 mRNA. In some embodiments, the inhibitory nucleic acid molecule is an siRNA that hybridizes to ERAP1 mRNA. In some embodiments, the inhibitory nucleic acid molecule is an shRNA that hybridizes to ERAP1 mRNA. In some embodiments, the ERAP1 inhibitor comprises an anti-ERAP1 antibody.

HLA-class-I antibodies can be generated by numerous methodologies with different degrees of antigen/allele speci-ficity attained and are reported to be used for in vitro assays. HLA-B*27 antibodies can be generated by numerous meth-odologies. In addition, three commercially available anti-bodies for HLA-B27 flow cytometric screening include the monoclonal mouse anti-human ABC-m3, FD705, and GS145.2 which have been shown to each have differing levels of cross-reactivity to other HLA-B antigens/alleles (Levering et al., Cytometry B Clin. Cytom., 2003, 54, 28-38). HLA-B*51 antibodies can also be generated by numerous methodologies. For example, antibodies to a broader HLA-Bw4 epitope can be obtained from clone REA274 (e.g., HLA-B members: B5, B5102, B5103, B13, B17, B37, B38, B44, B47, B49, B51, B52, B53, B57, B58, B59, B63, and B77; HLA-A members: A9, A23, A24, A25, and A*32). In addition, antibodies to HLA-B*51/B*52/B*35 can be obtained from clone HDG8D9 (Drabbels et al., Blood, 2011, 118, e149-55). HLA-C*06 antibodies can also be generated by numerous methodologies. For example, pan HLA-C antibodies can be obtained from clone DT-9 (which also recognizes HLA-E) (Braud et al., Curr. Biol., 1998, 8, 1-10). Broad anti-HLA-C antibodies can be obtained from clone L31 (which also recognizes some HLA-B alleles) (Setini et al., Hum. Immunol., 1996, 46, 69-81). HLA-Cw6 scFv can also be generated which has weak binding to HLA-Cw2,4,5 (Marget et al., Mol. Immunol., 2005, 42, 643-649).

In some embodiments, the assay for determining whether the subject comprises an MHC-I-opathy-related and/or MHC-II-opathy-related HLA genotype and a functional ERAP2 protein and/or ERAP1 protein, or a nucleic acid molecule encoding a functional ERAP2 protein and/or ERAP1 protein, is a genotyping assay or sequencing assay. In some embodiments, the nucleic acid molecule encoding a functional ERAP2 protein and/or ERAP1 protein com-prises genomic DNA, mRNA, or cDNA obtained from mRNA. By comparing the nucleotide or protein sequence of the ERAP2 protein and/or ERAP1 protein in the sample from a subject to the wild type sequence for ERAP2 protein and/or ERAP1 protein or nucleic acid molecule, or to published sequences of variant ERAP2 proteins and/or ERAP1 proteins or nucleic acid molecules having reduced or no activity, a determination can be made whether the subject comprises a functional ERAP2 protein and/or ERAP1 protein, or a nucleic acid molecule encoding a functional ERAP2 protein and/or ERAP1 protein. In addi-tion, although an individual ERAP2 protein and/or ERAP1 protein may have biological activity, the overall function of the ERAP2 protein and/or ERAP1 protein may not be functional due to reduced levels of expression. Thus, as used herein, an ERAP2 protein and/or ERAP1 protein can be determined not to be functional because the ERAP2 protein and/or ERAP1 protein lacks or had reduced biological activity or because the expression level is reduced.

Determining whether a subject has an MHC-I-opathy-related and/or MHC-II-opathy-related HLA genotype and/or a functional ERAP2 protein and/or ERAP1 protein, or a nucleic acid molecule encoding a functional ERAP2 protein and/or ERAP1 protein, in a biological sample from a subject can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a biological sample obtained from the subject.

The biological sample can be derived from any cell, tissue, or biological fluid from the subject. The biological sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any particular nucleic acid molecule, preliminary processing designed to isolate or enrich the biological sample for the particular nucleic acid molecule can be employed. A variety of techniques may be used for this purpose. Various methods to detect the presence or level of an mRNA molecule or the presence of a particular genomic DNA locus can be used.

In some embodiments, the biological sample comprises a cell or cell lysate. Such methods can further comprise, for example, obtaining a biological sample from the subject comprising genomic nucleic acid molecules or mRNA molecules, and if mRNA, optionally reverse transcribing the mRNA into cDNA. In some embodiments, the method is an in vitro method. In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

Administration of any of the therapeutic agents described herein (including the ERAP2 inhibitor, the ERAP1 agonist or inhibitor, and/or the HLA inhibitor) can be in a therapeutically effective amount to be determined by a health care professional. Administration of any of the therapeutic agents can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more.

Administration of any of the therapeutic agents can occur by any suitable route including, but not limited to, parenteral, intravenous, oral, subcutaneous, intra-arterial, intracranial, intrathecal, intraperitoneal, topical, intranasal, intra-articular, intravitreal, intracameral, subretinal, suprachoroidal, or intramuscular.

Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in an MHC-I-opathy and/or MHC-II-opathy, a decrease/reduction in the severity of an MHC-I-opathy and/or MHC-II-opathy (such as, for example, a reduction or inhibition of development of an MHC-I-opathy and/or MHC-II-opathy), a decrease/reduction in symptoms and MHC-I-opathy-related effects and/or MHC-II-opathy-related effects, delaying the onset of symptoms and MHC-I-opathy-related effects and/or MHC-II-opathy-related effects, reducing the severity of symptoms of MHC-I-opathy-related effects and/or MHC-II-opathy-related effects, reducing the severity of an acute episode, reducing the number of symptoms and MHC-I-opathy-related effects and/or MHC-II-opathy-related effects, reducing the latency of symptoms and MHC-I-opathy-related effects and/or MHC-II-opathy-related effects, an amelioration of symptoms and MHC-I-opathy-related effects and/or MHC-II-opathy-related effects, reducing secondary symptoms, reducing secondary infections, preventing relapse to an MHC-I-opathy and/or MHC-II-opathy, decreasing the number or frequency of relapse episodes, increasing latency between symptomatic episodes, increasing time to sustained progression, speeding recovery, or increasing efficacy of or decreasing resistance to alternative therapeutics, and/or an increased survival time of the subject, following administration of the agent or composition comprising the agent. A prophylactic effect may comprise a complete or partial avoidance/inhibition or a delay of an MHC-I-opathy and/or MHC-II-opathy development/progression (such as, for example, a complete or partial avoidance/inhibition or a delay), and an increased survival time of the affected subject, following administration of a therapeutic protocol. Treatment of an MHC-I-opathy and/or MHC-II-opathy encompasses the treatment of subjects already diagnosed as having any form of the MHC-I-opathy and/or MHC-II-opathy at any clinical stage or manifestation, the delay of the onset or evolution or aggravation or deterioration of the symptoms or signs of an MHC-I-opathy and/or MHC-II-opathy, and/or preventing and/or reducing the severity of an MHC-I-opathy and/or MHC-II-opathy.

In some embodiments, the antisense nucleic acid molecules targeted to ERAP2 comprise or consist of the nucleotide sequences shown in Table 1.

TABLE 1

| Sequence | SEQ ID NO: |
|---|---|
| AUCUGCCUGUUUGAGUUGGG | 1 |
| UAUCUGCCUGUUUGAGUUGG | 2 |
| UUAUCUGCCUGUUUGAGUUG | 3 |
| CUUUAUCUGCCUGUUUGAGU | 4 |
| UGAUCUCUCUUUAUCUGCCU | 5 |
| UUGAUCUCUCUUUAUCUGCC | 6 |
| UCAUGCUCAUCUCUUUGAUC | 7 |
| CUCAUGCUCAUCUCUUUGAU | 8 |
| GGACUGUAUCUCAUGCUCAU | 9 |
| GGGACUGUAUCUCAUGCUCA | 10 |
| CGGGCAGCUUCUGUGAUCUU | 11 |
| UUUAAUCAAACACCUCCCGG | 12 |
| AUUUAAUCAAACACCUCCCG | 13 |
| CUCCAGUUAUGUCACAUGGG | 14 |
| GGCUCCAGUUAUGUCACAUG | 15 |
| CUGGCUCCAGUUAUGUCACA | 16 |
| AGUUCUUCAUGGCACUGCAC | 17 |
| UAGUUCUUCAUGGCACUGCA | 18 |
| AGACAAGUUAAUAUCCAGGC | 19 |
| GCAGAAGAAUGGAACAUGAA | 20 |
| GUGUGAAUUAACCAUUGCAG | 21 |
| CUGUGUGAAUUAACCAUUGC | 22 |
| AGCAGUAAAAUCCUCUGUGA | 23 |
| AAGCAGUAAAAUCCUCUGUG | 24 |
| GGCUGUUAAGCAGUAAAAUC | 25 |
| GAUGGCUGUUAAGCAGUAAA | 26 |
| AAGAUGGCUGUUAAGCAGUA | 27 |
| CAAGAUGGCUGUUAAGCAGU | 28 |
| CACUGAGAACUGAGAACAAA | 29 |
| AUGGCACUGAGAACUGAGAA | 30 |
| GAUGGCACUGAGAACUGAGA | 31 |
| UAGAUGGCACUGAGAACUGA | 32 |
| CUAGAUGGCACUGAGAACUG | 33 |
| GAUAACUAGAUGGCACUGAG | 34 |
| UGAUAACUAGAUGGCACUGA | 35 |

TABLE 1-continued

| Sequence | SEQ ID NO: |
|---|---|
| GUGAUAACUAGAUGGCACUG | 36 |
| GAAGUGAUAACUAGAUGGCA | 37 |
| UGAAGUGAUAACUAGAUGGC | 38 |
| GUGAAGUGAUAACUAGAUGG | 39 |
| CUCAGUGAAGUGAUAACUAG | 40 |
| CCUCAGUGAAGUGAUAACUA | 41 |
| UCCUCAGUGAAGUGAUAACU | 42 |
| GAUCCUCAGUGAAGUGAUAA | 43 |
| UUAGUGGCUACUGGGAAAGC | 44 |
| AUUAGUGGCUACUGGGAAAG | 45 |
| CAUUAGUGGCUACUGGGAAA | 46 |
| CCAUUAGUGGCUACUGGGAA | 47 |

In some embodiments, the antisense nucleic acid molecules targeted to ERAP2 comprise or consist of the nucleotide sequences shown in Table 2.

TABLE 2

| Sequence | SEQ ID NO: |
|---|---|
| AUCUUAAAUCAUGCUGCUGC | 48 |
| CUCCAGUUAUGUCACAUGGG | 49 |
| GGCUCCAGUUAUGUCACAUG | 50 |
| CUGGCUCCAGUUAUGUCACA | 51 |
| AGUUCUUCAUGGCACUGCAC | 52 |
| UAGUUCUUCAUGGCACUGCA | 53 |
| AGACAAGUUAAUAUCCAGGC | 54 |
| GCAGAAGAAUGGAACAUGAA | 55 |
| GUGUGAAUUAACCAUUGCAG | 56 |
| CUGUGUGAAUUAACCAUUGC | 57 |
| AGCAGUAAAAUCCUCUGUGA | 58 |
| AAGCAGUAAAAUCCUCUGUG | 59 |
| GGCUGUUAAGCAGUAAAAUC | 60 |
| GAUGGCUGUUAAGCAGUAAA | 61 |
| AAGAUGGCUGUUAAGCAGUA | 62 |
| CAAGAUGGCUGUUAAGCAGU | 63 |
| CACUGAGAACUGAGAACAAA | 64 |
| AUGGCACUGAGAACUGAGAA | 65 |
| GAUGGCACUGAGAACUGAGA | 66 |
| UAGAUGGCACUGAGAACUGA | 67 |
| CUAGAUGGCACUGAGAACUG | 68 |
| GAUAACUAGAUGGCACUGAG | 69 |

TABLE 2-continued

| Sequence | SEQ ID NO: |
| --- | --- |
| UGAUAACUAGAUGGCACUGA | 70 |
| GUGAUAACUAGAUGGCACUG | 71 |
| GAAGUGAUAACUAGAUGGCA | 72 |
| UGAAGUGAUAACUAGAUGGC | 73 |
| GUGAAGUGAUAACUAGAUGG | 74 |
| CUCAGUGAAGUGAUAACUAG | 75 |
| CCUCAGUGAAGUGAUAACUA | 76 |
| UCCUCAGUGAAGUGAUAACU | 77 |
| GAUCCUCAGUGAAGUGAUAA | 78 |
| UUAGUGGCUACUGGGAAAGC | 79 |
| AUUAGUGGCUACUGGGAAAG | 80 |
| CAUUAGUGGCUACUGGGAAA | 81 |
| CCAUUAGUGGCUACUGGGAA | 82 |
| UAAUGGAGAGGAAUGACCAC | 83 |
| AUAAUGGAGAGGAAUGACCA | 84 |
| AGAGGUCAUAAUGGAGAGGA | 85 |
| AAGAGGUCAUAAUGGAGAGG | 86 |
| AAAGAGGUCAUAAUGGAGAG | 87 |
| CAAAGAGGUCAUAAUGGAGA | 88 |
| ACAAAGAGGUCAUAAUGGAG | 89 |
| GGACAAAGAGGUCAUAAUGG | 90 |
| AAAGUCCAGAGAGGUGAGAU | 91 |
| CAAAGUCCAGAGAGGUGAGA | 92 |
| AUGCAACAAAGUCCAGAGAG | 93 |
| GAUGCAACAAAGUCCAGAGA | 94 |
| AGAUGCAACAAAGUCCAGAG | 95 |
| CUCAGAUGCAACAAAGUCCA | 96 |
| UUCUCAGAUGCAACAAAGUC | 97 |
| CUUCUCAGAUGCAACAAAGU | 98 |
| AGCAUUGCUGACCAAGACUU | 99 |
| UAGCAUUGCUGACCAAGACU | 100 |
| GUAGCAUUGCUGACCAAGAC | 101 |
| GGUAGCAUUGCUGACCAAGA | 102 |
| GGGUAGCAUUGCUGACCAAG | 103 |
| UGGGUAGCAUUGCUGACCAA | 104 |
| AAACUGGGUAGCAUUGCUGA | 105 |
| UAAACUGGGUAGCAUUGCUG | 106 |
| UGAUAAACUGGGUAGCAUUG | 107 |
| AGAUGAUAAACUGGGUAGCA | 108 |

TABLE 2-continued

| Sequence | SEQ ID NO: |
| --- | --- |
| AAGAUGAUAAACUGGGUAGC | 109 |
| CAAGAUGAUAAACUGGGUAG | 110 |
| GCAAGAUGAUAAACUGGGUA | 111 |
| GUGCAAGAUGAUAAACUGGG | 112 |
| UGUGCAAGAUGAUAAACUGG | 113 |
| CUGUGCAAGAUGAUAAACUG | 114 |
| GCUGUGCAAGAUGAUAAACU | 115 |
| GGCAUUCGUGAUUUCAAGAU | 116 |
| UGGCAUUCGUGAUUUCAAGA | 117 |
| GUGGCAUUCGUGAUUUCAAG | 118 |
| GGUGGCAUUCGUGAUUUCAA | 119 |
| GGGUGGCAUUCGUGAUUUCA | 120 |
| AGGGUGGCAUUCGUGAUUUC | 121 |
| AAGGGUGGCAUUCGUGAUUU | 122 |
| CUGAAGGGUGGCAUUCGUGA | 123 |
| ACUGAAGGGUGGCAUUCGUG | 124 |
| GACUGAAGGGUGGCAUUCGU | 125 |
| UGACUGAAGGGUGGCAUUCG | 126 |
| CUGACUGAAGGGUGGCAUUC | 127 |
| UCUGACUGAAGGGUGGCAUU | 128 |
| CUCUGACUGAAGGGUGGCAU | 129 |
| CCUCUGACUGAAGGGUGGCA | 130 |
| UCCUCUGACUGAAGGGUGGC | 131 |
| UUCCUCUGACUGAAGGGUGG | 132 |
| UUGAAUCUUCCUCUGACUGA | 133 |
| CUUGAAUCUUCCUCUGACUG | 134 |
| UCUUGAAUCUUCCUCUGACU | 135 |
| GUAUCUUGAAUCUUCCUCUG | 136 |
| UCCUGGUUUCAUGUAUCUUG | 137 |
| GCAGGGUAACUCAAAACUUU | 138 |
| AGCAGGGUAACUCAAAACUU | 139 |
| GAGCAGGGUAACUCAAAACU | 140 |
| AGCAGUGCAAUUUGUUCAUG | 141 |
| CAGCAGUGCAAUUUGUUCAU | 142 |
| CCAGCAGUGCAAUUUGUUCA | 143 |
| ACCAGCAGUGCAAUUUGUUC | 144 |
| AACCAGCAGUGCAAUUUGUU | 145 |
| GAACCAGCAGUGCAAUUUGU | 146 |
| GGAACCAGCAGUGCAAUUUG | 147 |

21

22

TABLE 2-continued

TABLE 2-continued

| Sequence | SEQ ID NO: |
|----------|------------|
| UCUGGAACCAGCAGUGCAAU | 148 |
| UCUCUGGAACCAGCAGUGCA | 149 |
| UUCUCUGGAACCAGCAGUGC | 150 |
| UUUCUCUGGAACCAGCAGUG | 151 |
| CGUAAGUUUCUCUGGAACCA | 152 |
| GCGUAAGUUUCUCUGGAACC | 153 |
| GGCGUAAGUUUCUCUGGAAC | 154 |
| AGGCGUAAGUUUCUCUGGAA | 155 |
| GAGGCGUAAGUUUCUCUGGA | 156 |
| UGAGGCGUAAGUUUCUCUGG | 157 |
| GUGAGGCGUAAGUUUCUCUG | 158 |
| GGUGAGGCGUAAGUUUCUCU | 159 |
| AGGUGAGGCGUAAGUUUCUC | 160 |
| CAGGUGAGGCGUAAGUUUCU | 161 |
| UCAGGUGAGGCGUAAGUUUC | 162 |
| UUCAGGUGAGGCGUAAGUUU | 163 |
| UUUCAGGUGAGGCGUAAGUU | 164 |
| AUUUCAGGUGAGGCGUAAGU | 165 |
| UAUUUCAGGUGAGGCGUAAG | 166 |
| GUAUUUCAGGUGAGGCGUAA | 167 |
| AGUAUUUCAGGUGAGGCGUA | 168 |
| AUAGUAUUUCAGGUGAGGCG | 169 |
| CAUAGUAUUUCAGGUGAGGC | 170 |
| CACAUAGUAUUUCAGGUGAG | 171 |
| AGCCACAUAGUAUUUCAGGU | 172 |
| UAGCCACAUAGUAUUUCAGG | 173 |
| CCAUAGCCACAUAGUAUUUC | 174 |
| AGUCCAUAGCCACAUAGUAU | 175 |
| AAGUCCAUAGCCACAUAGUA | 176 |
| GAAGUCCAUAGCCACAUAGU | 177 |
| GGAAGUCCAUAGCCACAUAG | 178 |
| UGGAAGUCCAUAGCCACAUA | 179 |
| GCUUGGAAGUCCAUAGCCAC | 180 |
| UUGGCUUGGAAGUCCAUAGC | 181 |
| CACCUAACUUGGCUUGGAAG | 182 |
| AUCACCUAACUUGGCUUGGA | 183 |
| CAUCACCUAACUUGGCUUGG | 184 |
| CCAUCACCUAACUUGGCUUG | 185 |
| CAAAGCCAUCACCUAACUUG | 186 |

| Sequence | SEQ ID NO: |
|----------|------------|
| UCAAAGCCAUCACCUAACUU | 187 |
| UUCAAAGCCAUCACCUAACU | 188 |
| CUUCAAAGCCAUCACCUAAC | 189 |
| ACCCUUCAAAGCCAUCACCU | 190 |
| AACCCUUCAAAGCCAUCACC | 191 |
| CAAGAGUUCUGUAUGUGCUU | 192 |
| CCAAGAGUUCUGUAUGUGCU | 193 |
| ACCAAGAGUUCUGUAUGUGC | 194 |
| CACCAAGAGUUCUGUAUGUG | 195 |
| CCACCAAGAGUUCUGUAUGU | 196 |
| ACCACCAAGAGUUCUGUAUG | 197 |
| GGCUCAAAAUCUGUUACUGC | 198 |
| UGGCUCAAAAUCUGUUACUG | 199 |
| UGGGUUGGCUCAAAAUCUGU | 200 |
| CUGGGUUGGCUCAAAAUCUG | 201 |
| CCUGGGUUGGCUCAAAAUCU | 202 |
| UGCCUGGGUUGGCUCAAAAU | 203 |
| GUGCCUGGGUUGGCUCAAAA | 204 |
| CGUGCCUGGGUUGGCUCAAA | 205 |
| AAGCCAUGCGUGCCUGGGUU | 206 |
| AAAGCCAUGCGUGCCUGGGU | 207 |
| AGGGAAAGCCAUGCGUGCCU | 208 |
| AAGGGAAAGCCAUGCGUGCC | 209 |
| GCAAGGGAAAGCCAUGCGUG | 210 |
| AAGCAAGGGAAAGCCAUGCG | 211 |
| CAAAGCAAGGGAAAGCCAUG | 212 |
| CAUCAAAGCAAGGGAAAGCC | 213 |
| GUUCAUCAAAGCAAGGGAAA | 214 |
| CUCUCUUCGUAUCUUGAUUG | 215 |
| GCUCUCUUCGUAUCUUGA | 216 |
| CCUGCUCUCUCUUCGUAUCU | 217 |
| GCCUGCUCUCUCUUCGUAUC | 218 |
| GUGCAAUAUGCCUGCUCUCU | 219 |
| AGUGCAAUAUGCCUGCUCUC | 220 |
| UAGUGCAAUAUGCCUGCUCU | 221 |
| AUAGUGCAAUAUGCCUGCUC | 222 |
| UGGAUAGUGCAAUAUGCCUG | 223 |
| UUGGAUAGUGCAAUAUGCCU | 224 |
| GUUGGAUAGUGCAAUAUGCC | 225 |

TABLE 2-continued

| Sequence | SEQ ID NO: |
|---|---|
| UGUUGGAUAGUGCAAUAUGC | 226 |
| GCAUGUUGGAUAGUGCAAUA | 227 |
| GGCAUGUUGGAUAGUGCAAU | 228 |
| UGGCAUGUUGGAUAGUGCAA | 229 |
| UUGGCAUGUUGGAUAGUGCA | 230 |
| UUUGGCAUGUUGGAUAGUGC | 231 |
| CUUUGGCAUGUUGGAUAGUG | 232 |
| GACCUCCUUCAAGUUCAAUU | 233 |
| CAAAAGACCUCCUUCAAGUU | 234 |
| UCCAAAAGACCUCCUUCAAG | 235 |
| CUUCCAAAAGACCUCCUUCA | 236 |
| UCACAAACUAUGUAGGCUAC | 237 |
| AGAGAGUGGAAAUCACAAAC | 238 |
| UCAGAGAGUGGAAAUCACAA | 239 |
| CCCUGAUGAAGUGAAGCCAC | 240 |
| AUAGAUGGACACCUUGACCC | 241 |
| CAUAGAUGGACACCUUGACC | 242 |
| GCAUAGAUGGACACCUUGAC | 243 |
| UGCAUAGAUGGACACCUUGA | 244 |
| UUUGAUUCCGUUUGUCUGGG | 245 |
| GUUUGAUUCCGUUUGUCUGG | 246 |
| UGUUUGAUUCCGUUUGUCUG | 247 |
| GUGUUUGAUUCCGUUUGUCU | 248 |
| GCAUAAUGUGUUUGAUUCCG | 249 |
| UCAGUGAUGCCUGCAAAGCA | 250 |
| GUAGCUUCAGUGAUGCCUGC | 251 |
| AGUAGCUUCAGUGAUGCCUG | 252 |
| GGAGAGUGGAUAGUAGAUAU | 253 |
| UGGAGAGUGGAUAGUAGAUA | 254 |
| UUGGAGAGUGGAUAGUAGAU | 255 |
| UUUGGAGAGUGGAUAGUAGA | 256 |
| GUUUGGAGAGUGGAUAGUAG | 257 |
| CAGUUUGGAGAGUGGAUAGU | 258 |
| GCAAAGUCAGGAAUAGCAAU | 259 |
| UGCAAAGUCAGGAAUAGCAA | 260 |
| GUGCAAAGUCAGGAAUAGCA | 261 |
| GGUGCAAAGUCAGGAAUAGC | 262 |
| AGGUGCAAAGUCAGGAAUAG | 263 |
| CAGGUGCAAAGUCAGGAAUA | 264 |

TABLE 2-continued

| Sequence | SEQ ID NO: |
|---|---|
| CCAGGUGCAAAGUCAGGAAU | 265 |
| UCCAGGUGCAAAGUCAGGAA | 266 |
| CUCCAGGUGCAAAGUCAGGA | 267 |
| GCUCCAGGUGCAAAGUCAGG | 268 |
| GGCUCCAGGUGCAAAGUCAG | 269 |
| CUCCCUAUAUGUAAUGAGGC | 270 |
| GGAAGCAGAAGAGGUCUUGG | 271 |
| CGGAAGCAGAAGAGGUCUUG | 272 |
| UCGGAAGCAGAAGAGGUCUU | 273 |
| AUCGGAAGCAGAAGAGGUCU | 274 |
| UAUCGGAAGCAGAAGAGGUC | 275 |
| UUAUCGGAAGCAGAAGAGGU | 276 |
| UUUAUCGGAAGCAGAAGAGG | 277 |
| GUUUAUCGGAAGCAGAAGAG | 278 |
| AGUUUAUCGGAAGCAGAAGA | 279 |
| CAGUUUAUCGGAAGCAGAAG | 280 |
| CCACAGUUUAUCGGAAGCAG | 281 |
| CCCACAGUUUAUCGGAAGCA | 282 |
| ACCCACAGUUUAUCGGAAGC | 283 |
| GACCCACAGUUUAUCGGAAG | 284 |
| UGACCCACAGUUUAUCGGAA | 285 |
| GUGACCCACAGUUUAUCGGA | 286 |
| GGUGACCCACAGUUUAUCGG | 287 |
| UGGUGACCCACAGUUUAUCG | 288 |
| CUGGUGACCCACAGUUUAUC | 289 |
| CUCUGGUGACCCACAGUUUA | 290 |
| ACUCUGGUGACCCACAGUUU | 291 |
| GACUCUGGUGACCCACAGUU | 292 |
| AUGACUCUGGUGACCCACAG | 293 |
| UAUGACUCUGGUGACCCACA | 294 |
| CUAUGACUCUGGUGACCCAC | 295 |
| GGCUAUGACUCUGGUGACCC | 296 |
| GGGCUAUGACUCUGGUGACC | 297 |
| UGGGCUAUGACUCUGGUGAC | 298 |
| AUGGGCUAUGACUCUGGUGA | 299 |
| GCGCCAGUUCAUGGGCUAUG | 300 |
| GUGCGCCAGUUCAUGGGCUA | 301 |
| UUGCCAAACCACUGGUGCGC | 302 |
| GUUGCCAAACCACUGGUGCG | 303 |

TABLE 2-continued

| Sequence | SEQ ID NO: |
|---|---|
| UUGUGACCAGGUUGCCAAAC | 304 |
| AUUGUGACCAGGUUGCCAAA | 305 |
| CAUUGUGACCAGGUUGCCAA | 306 |
| UCCAUUGUGACCAGGUUGCC | 307 |
| UUCCAUUGUGACCAGGUUGC | 308 |
| AUUCCAUUGUGACCAGGUUG | 309 |
| CCAUUCCAUUGUGACCAGGU | 310 |
| ACCAUUCCAUUGUGACCAGG | 311 |
| CACCAUUCCAUUGUGACCAG | 312 |
| CCACCAUUCCAUUGUGACCA | 313 |
| UCCACCAUUCCAUUGUGACC | 314 |
| UUCCACCAUUCCAUUGUGAC | 315 |
| CAGCGAUAAGUUCCAUGUAU | 316 |
| ACAGCGAUAAGUUCCAUGUA | 317 |
| AACAGCGAUAAGUUCCAUGU | 318 |
| UAACAGCGAUAAGUUCCAUG | 319 |
| CAUUAACAGCGAUAAGUUCC | 320 |
| GCAUUAACAGCGAUAAGUUC | 321 |
| GUAGCAUUAACAGCGAUAAG | 322 |
| GAUAUGUAGCAUUAACAGCG | 323 |
| GCUCUGGAUAUGUAGCAUUA | 324 |
| GUUUCCGCUGGUUUGGAGAU | 325 |
| GGUUUCCGCUGGUUUGGAGA | 326 |
| GGGUUUCCGCUGGUUUGGAG | 327 |
| CAUUUCCUGUAUUUGAGUCG | 328 |
| CCCUUGUUAUAGGAAACUUC | 329 |
| CUCCCUUGUUAUAGGAAACU | 330 |
| GCUCCCUUGUUAUAGGAAAC | 331 |
| AGCUCCCUUGUUAUAGGAAA | 332 |
| AAGCUCCCUUGUUAUAGGAA | 333 |
| CCCAGAAAAUCCUUGAGCAU | 334 |
| CUCACCCAGAAAAUCCUUGA | 335 |
| CUCCUCACCCAGAAAAUCCU | 336 |
| UCUCCUCACCCAGAAAAUCC | 337 |
| CCACAAGUCAUCAUUCUUAG | 338 |
| CUGCUCCACAAGUCAUCAUU | 339 |
| ACUGCUCCACAAGUCAUCAU | 340 |
| UGACAGACUGCUCCACAAGU | 341 |
| UUGACAGACUGCUCCACAAG | 342 |

TABLE 2-continued

| Sequence | SEQ ID NO: |
|---|---|
| AUUUGACAGACUGCUCCACA | 343 |
| UAUUUGACAGACUGCUCCAC | 344 |
| CUAUUUGACAGACUGCUCCA | 345 |
| ACUAUUUGACAGACUGCUCC | 346 |
| AACUAUUUGACAGACUGCUC | 347 |
| CAACUAUUUGACAGACUGCU | 348 |
| ACAACUAUUUGACAGACUGC | 349 |
| CCACCAGAUGUAAAAUCACU | 350 |
| UCCACCAGAUGUAAAAUCAC | 351 |
| GACAAACUCCACCAGAUGUA | 352 |
| CGAAUGACAAACUCCACCAG | 353 |
| CCGAAUGACAAACUCCACCA | 354 |
| GAUCCGAAUGACAAACUCCA | 355 |
| AUGUUACUUGUCAUCUUGGG | 356 |
| GCAUGUUACUUGUCAUCUUG | 357 |
| GAGCAUGUUACUUGUCAUCU | 358 |
| CGAGCAUGUUACUUGUCAUC | 359 |
| GCGAGCAUGUUACUUGUCAU | 360 |
| GGCGAGCAUGUUACUUGUCA | 361 |
| AGGCGAGCAUGUUACUUGUC | 362 |
| AAGGCGAGCAUGUUACUUGU | 363 |
| AAAGGCGAGCAUGUUACUUG | 364 |
| GAAAGGCGAGCAUGUUACUU | 365 |
| AGAAAGGCGAGCAUGUUACU | 366 |
| CAGAAAGGCGAGCAUGUUAC | 367 |
| CCAGAAAGGCGAGCAUGUUA | 368 |
| CCCAGAAAGGCGAGCAUGUU | 369 |
| UCUUUGACCUCUGCAUUUUC | 370 |
| AUCAUCUCUUUGACCUCUGC | 371 |
| CCAUGUAGUCAUCAUCUCUU | 372 |
| AGAGUCCAUGUAGUCAUCAU | 373 |
| GAGAGUCCAUGUAGUCAUCA | 374 |
| GGAGAGUCCAUGUAGUCAUC | 375 |
| GAUUCCUUUCUGGAGAGUCC | 376 |
| UUGUUUAACCACCAGCAGGG | 377 |
| CUUGUUUAACCACCAGCAGG | 378 |
| UCUUGUUUAACCACCAGCAG | 379 |
| CGUCUUGUUUAACCACCAGC | 380 |
| CCGUCUUGUUUAACCACCAG | 381 |

TABLE 2-continued

| Sequence | SEQ ID NO: |
|---|---|
| CCCGUCUUGUUUAACCACCA | 382 |
| ACCCGUCUUGUUUAACCACC | 383 |
| CACCCGUCUUGUUUAACCAC | 384 |
| ACACCCGUCUUGUUUAACCA | 385 |
| GGAGUGAACACCCGUCUUGU | 386 |
| CGGAGUGAACACCCGUCUUG | 387 |
| UCGGAGUGAACACCCGUCUU | 388 |
| GUCGGAGUGAACACCCGUCU | 389 |
| AGUCGGAGUGAACACCCGUC | 390 |
| CAGUCGGAGUGAACACCCGU | 391 |
| UGCAGUCGGAGUGAACACCC | 392 |
| UUGCAGUCGGAGUGAACACC | 393 |
| GUUGCAGUCGGAGUGAACAC | 394 |
| CCUCCAUUCAGGGUCUUCCU | 395 |
| AUGGGAUAUGCCACAGGUAC | 396 |
| AAUGGGAUAUGCCACAGGUA | 397 |
| CAAUGGGAUAUGCCACAGGU | 398 |
| UCAAUGGGAUAUGCCACAGG | 399 |
| GUAGGUCAAUGGGAUAUGCC | 400 |
| AGUAGGUCAAUGGGAUAUGC | 401 |
| GAGUAGGUCAAUGGGAUAUG | 402 |
| GGAGUAGGUCAAUGGGAUAU | 403 |
| UGGAGUAGGUCAAUGGGAUA | 404 |
| CGUGGAGUAGGUCAAUGGGA | 405 |
| UCGUGGAGUAGGUCAAUGGG | 406 |
| CUCGUGGAGUAGGUCAAUGG | 407 |
| CAUUAGAAGAACUCGUGGAG | 408 |
| ACAUUAGAAGAACUCGUGGA | 409 |
| UCACAUUAGAAGAACUCGUG | 410 |
| GAUCACAUUAGAAGAACUCG | 411 |
| GGAUCACAUUAGAAGAACUC | 412 |
| GUGGAUCACAUUAGAAGAAC | 413 |
| AGAAUGUGUCUGUGGAUCAC | 414 |
| UAGAAUGUGUCUGUGGAUCA | 415 |
| UUUCAGGUAGAUCCAGAGUA | 416 |
| UUUUCAGGUAGAUCCAGAGU | 417 |
| UCUUUUCAGGUAGAUCCAGA | 418 |
| GUCUUUUCAGGUAGAUCCAG | 419 |
| GGUCUUUUCAGGUAGAUCCA | 420 |

TABLE 2-continued

| Sequence | SEQ ID NO: |
|---|---|
| CUGGUCUUUUCAGGUAGAUC | 421 |
| CCAACUGGUCUUUUCAGGUA | 422 |
| CCCAACUGGUCUUUUCAGGU | 423 |
| ACCCAACUGGUCUUUUCAGG | 424 |
| CACCCAACUGGUCUUUUCAG | 425 |
| UUCACCCAACUGGUCUUUUC | 426 |
| UUUCACCCAACUGGUCUUUU | 427 |
| AUUUCACCCAACUGGUCUUU | 428 |
| AAUUUCACCCAACUGGUCUU | 429 |
| GUAACCAUUUGAGUCCACAU | 430 |
| AGUAACCAUUUGAGUCCACA | 431 |
| GUAGUAACCAUUUGAGUCCA | 432 |
| UGUAGUAACCAUUUGAGUCC | 433 |
| CGAUGUAGUAACCAUUUGAG | 434 |
| AGUGAACGAUGUAGUAACCA | 435 |
| UAGUGAACGAUGUAGUAACC | 436 |
| CUCAUAGUGAACGAUGUAGU | 437 |
| CCUCAUAGUGAACGAUGUAG | 438 |
| CCCUCAUAGUGAACGAUGUA | 439 |
| ACCCUCAUAGUGAACGAUGU | 440 |
| GACCCUCAUAGUGAACGAUG | 441 |
| UGACCCUCAUAGUGAACGAU | 442 |
| GAGUUGGUCCCAUCCAUGAC | 443 |
| AUGAGUUGGUCCCAUCCAUG | 444 |
| AAUGAGUUGGUCCCAUCCAU | 445 |
| UAAUGAGUUGGUCCCAUCCA | 446 |
| GUAAUGAGUUGGUCCCAUCC | 447 |
| UGUAAUGAGUUGGUCCCAUC | 448 |
| GUGUAAUGAGUUGGUCCCAU | 449 |
| UGUGUAAUGAGUUGGUCCCA | 450 |
| CUGUGUAAUGAGUUGGUCCC | 451 |
| GCUGUGUAAUGAGUUGGUCC | 452 |
| AGCUGUGUAAUGAGUUGGUC | 453 |
| GUGUGUGGUUCUGAUUCAGC | 454 |
| AAGUGUGUGGUUCUGAUUCA | 455 |
| CUUAGGUCUGAGAAGUGUGU | 456 |
| CCUUAGGUCUGAGAAGUGUG | 457 |
| UCCUUAGGUCUGAGAAGUGU | 458 |
| GUCCUUAGGUCUGAGAAGUG | 459 |

TABLE 2-continued

| Sequence | SEQ ID NO: |
|----------|------------|
| UGUCCUUAGGUCUGAGAAGU | 460 |
| ACUCUGUCCUUAGGUCUGAG | 461 |
| UACUCUGUCCUUAGGUCUGA | 462 |
| CUACUCUGUCCUUAGGUCUG | 463 |
| UCAGUCUCCCUGCACCAACU | 464 |
| GUCAGUCUCCCUGCACCAAC | 465 |
| GGUCAGUCUCCCUGCACCAA | 466 |
| UUGUCUAGGGUCAGUCUCCC | 467 |
| UUUGUCUAGGGUCAGUCUCC | 468 |
| CUUUGUCUAGGGUCAGUCUC | 469 |
| GCUUUGUCUAGGGUCAGUCU | 470 |
| AGCUUUGUCUAGGGUCAGUC | 471 |
| GAGCUUUGUCUAGGGUCAGU | 472 |
| AAGAGCUUUGUCUAGGGUCA | 473 |
| CAAGAGCUUUGUCUAGGGUC | 474 |
| UCAAGAGCUUUGUCUAGGGU | 475 |
| UGUCAAGAGCUUUGUCUAGG | 476 |
| AUGUCAAGAGCUUUGUCUAG | 477 |
| CAUGUCAAGAGCUUUGUCUA | 478 |
| GUCAUGUCAAGAGCUUUGUC | 479 |
| AAGUCAUGUCAAGAGCUUUG | 480 |
| GUAAGUCAUGUCAAGAGCUU | 481 |
| AGUAAGUCAUGUCAAGAGCU | 482 |
| UAGUAAGUCAUGUCAAGAGC | 483 |
| GUAGUAAGUCAUGUCAAGAG | 484 |
| GGUAGUAAGUCAUGUCAAGA | 485 |
| AGGUAGUAAGUCAUGUCAAG | 486 |
| GGAGGUAGUAAGUCAUGUCA | 487 |
| UGGAGGUAGUAAGUCAUGUC | 488 |
| UUGGAGGUAGUAAGUCAUGU | 489 |
| GUUGGAGGUAGUAAGUCAUG | 490 |
| UGUUGGAGGUAGUAAGUCAU | 491 |
| AGACCUUCGAGAAGUGCGGG | 492 |
| CAGACCUUCGAGAAGUGCGG | 493 |
| ACUCAGACCUUCGAGAAGUG | 494 |
| AACUCAGACCUUCGAGAAGU | 495 |
| UAACUCAGACCUUCGAGAAG | 496 |
| GUAACUCAGACCUUCGAGAA | 497 |
| AGUAACUCAGACCUUCGAGA | 498 |

TABLE 2-continued

| Sequence | SEQ ID NO: |
|----------|------------|
| UCCAAGUAACUCAGACCUUC | 499 |
| UUCCAAGUAACUCAGACCUU | 500 |
| GAUUCCAAGUAACUCAGACC | 501 |
| CGAUUCCAAGUAACUCAGAC | 502 |
| GUGGUAAAACGAUUCCAAGU | 503 |
| UGUGGUAAAACGAUUCCAAG | 504 |
| CAUGUGGUAAAACGAUUCCA | 505 |
| UCAUGUGGUAAAACGAUUCC | 506 |
| CCAUCAUGUGGUAAAACGAU | 507 |
| CUGUCCAUCAUGUGGUAAAA | 508 |
| UCUGUCCAUCAUGUGGUAAA | 509 |
| UUCUGUCCAUCAUGUGGUAA | 510 |
| CCUUCUGUCCAUCAUGUGGU | 511 |
| CGCUUGAGGUUUUCAGAGAU | 512 |
| AACGCUUGAGGUUUUCAGAG | 513 |
| UAACGCUUGAGGUUUUCAGA | 514 |
| GUAACGCUUGAGGUUUUCAG | 515 |
| GGUAACGCUUGAGGUUUUCA | 516 |
| AGGUAACGCUUGAGGUUUUC | 517 |
| AAGGUAACGCUUGAGGUUUU | 518 |
| GAAGGUAACGCUUGAGGUUU | 519 |
| AGAAGGUAACGCUUGAGGUU | 520 |
| AAGAAGGUAACGCUUGAGGU | 521 |
| GAAGAAGGUAACGCUUGAGG | 522 |
| UGAAGAAGGUAACGCUUGAG | 523 |
| CUGAAGAAGGUAACGCUUGA | 524 |
| ACUGAAGAAGGUAACGCUUG | 525 |
| UACUGAAGAAGGUAACGCUU | 526 |
| CUGUCAAUCACUGGCUUAAA | 527 |
| CCUGUCAAUCACUGGCUUAA | 528 |
| GCCUGUCAAUCACUGGCUUA | 529 |
| UGCCUGUCAAUCACUGGCUU | 530 |
| UUGCCUGUCAAUCACUGGCU | 531 |
| UUUGCCUGUCAAUCACUGGC | 532 |
| GCUUUGCCUGUCAAUCACUG | 533 |
| AGCUUUGCCUGUCAAUCACU | 534 |
| CAGCUUUGCCUGUCAAUCAC | 535 |
| CCAGCUUUGCCUGUCAAUCA | 536 |
| UCCAGCUUUGCCUGUCAAUC | 537 |

TABLE 2-continued

| Sequence | SEQ ID NO: |
|---|---|
| CUCCAGCUUUGCCUGUCAAU | 538 |
| CACUCCAGCUUUGCCUGUCA | 539 |
| UCACUCCAGCUUUGCCUGUC | 540 |
| UUGUCACUCCAGCUUUGCCU | 541 |
| CUUGUCACUCCAGCUUUGCC | 542 |
| AGCAUCCUGUCCCAGACUGA | 543 |
| UCACAGGCCAGCUUCAAGAG | 544 |
| GGUCACAGGCCAGCUUCAAG | 545 |
| AGGUCACAGGCCAGCUUCAA | 546 |
| UCAGGUCACAGGCCAGCUUC | 547 |
| GUUCAGGUCACAGGCCAGCU | 548 |
| UGGUUCAGGUCACAGGCCAG | 549 |
| AUGGUUCAGGUCACAGGCCA | 550 |
| CAUGGUUCAGGUCACAGGCC | 551 |
| GAGCAUGGUUCAGGUCACAG | 552 |
| GGAGCAUGGUUCAGGUCACA | 553 |
| CAAGGAGCAUGGUUCAGGUC | 554 |
| GCAAGGAGCAUGGUUCAGGU | 555 |
| UGCAAGGAGCAUGGUUCAGG | 556 |
| CUUUCUGGAUGCAAGGAGCA | 557 |
| GCUUUCUGGAUGCAAGGAGC | 558 |
| GCAGCUUUCUGGAUGCAAGG | 559 |
| AGCAGCUUUCUGGAUGCAAG | 560 |
| CAGCAGCUUUCUGGAUGCAA | 561 |
| UCAGCAGCUUUCUGGAUGCA | 562 |
| GAGUUCAGCAGCUUUCUGGA | 563 |
| AAGAGUUCAGCAGCUUUCUG | 564 |
| AGAAGAGUUCAGCAGCUUUC | 565 |
| GAGAAGAGUUCAGCAGCUUU | 566 |
| UGAGCACCCACAGAAUACAC | 567 |
| UGUUGUCUGAGCACCCACAG | 568 |
| CUGUUGUCUGAGCACCCACA | 569 |
| GCUGUUGUCUGAGCACCCAC | 570 |
| AAAAGGUAAUUCCAUCCUGC | 571 |
| CACUUGACAUUGACAGUUCA | 572 |
| GCACUUGACAUUGACAGUUC | 573 |
| AGCACUUGACAUUGACAGUU | 574 |
| UUCAGCACUUGACAUUGACA | 575 |
| UGUUCAGCACUUGACAUUGA | 576 |

TABLE 2-continued

| Sequence | SEQ ID NO: |
|---|---|
| UUGUUCAGCACUUGACAUUG | 577 |
| CUCGUUGACAAAGCAUACAG | 578 |
| GCUCGUUGACAAAGCAUACA | 579 |
| AUGCUUGCUCGUUGACAAAG | 580 |
| GAUGCUUGCUCGUUGACAAA | 581 |
| UGAUGCUUGCUCGUUGACAA | 582 |
| CUGAUGCUUGCUCGUUGACA | 583 |
| CCUGAUGCUUGCUCGUUGAC | 584 |
| UCCUGAUGCUUGCUCGUUGA | 585 |
| UUCCUGAUGCUUGCUCGUUG | 586 |
| UUUCCUGAUGCUUGCUCGUU | 587 |
| UUUUCCUGAUGCUUGCUCGU | 588 |
| CUUUUCCUGAUGCUUGCUCG | 589 |
| CUUGAUAACCUUUCCUUCCA | 590 |
| UCUUGAUAACCUUUCCUUCC | 591 |
| GUCUUGAUAACCUUUCCUUC | 592 |
| GUGUCUUGAUAACCUUUCCU | 593 |
| GUUCUGUGUCUUGAUAACCU | 594 |
| GCUGCCAAGUUCUGUGUCUU | 595 |
| AGCUGCCAAGUUCUGUGUCU | 596 |
| AGAGCUGCCAAGUUCUGUGU | 597 |
| GGAGAGCUGCCAAGUUCUGU | 598 |
| AAGGAGAGCUGCCAAGUUCU | 599 |
| GAAGGAGAGCUGCCAAGUUC | 600 |
| AUGAAGGAGAGCUGCCAAGU | 601 |
| CAUGAAGGAGAGCUGCCAAG | 602 |
| GCAUGAAGGAGAGCUGCCAA | 603 |
| CGCAUGAAGGAGAGCUGCCA | 604 |
| UCGCAUGAAGGAGAGCUGCC | 605 |
| AUCGCAUGAAGGAGAGCUGC | 606 |
| CAAUCGCAUGAAGGAGAGCU | 607 |
| GCAAUCGCAUGAAGGAGAGC | 608 |
| GGCAAUCGCAUGAAGGAGAG | 609 |
| CUGGCAAUCGCAUGAAGGAG | 610 |
| UCUGGCAAUCGCAUGAAGGA | 611 |
| GUCUGGCAAUCGCAUGAAGG | 612 |
| CGUCUGGCAAUCGCAUGAAG | 613 |
| ACGUCUGGCAAUCGCAUGAA | 614 |
| UCUCUUACAAAAUCCCAUGC | 615 |

33

34

TABLE 2-continued

TABLE 2-continued

| Sequence | SEQ ID NO: |
|---|---|
| AGAAGAUGGGUCCAAUUUUC | 616 |
| CAGAAGAUGGGUCCAAUUUU | 617 |
| UCAGAAGAUGGGUCCAAUUU | 618 |
| UUCAGAAGAUGGGUCCAAUU | 619 |
| AAGUGAGCUGUUGUGCCAGA | 620 |
| AGAAAGUGAGCUGUUGUGC | 621 |
| GAAGAAAGUGAGCUGUUGU | 622 |
| GAGCCUCAAGAGAUUCAAAA | 623 |
| UGAGCCUCAAGAGAUUCAAA | 624 |
| CAGAUGUGAUCCUUGAGCCU | 625 |
| CCAGAUGUGAUCCUUGAGCC | 626 |
| UCCAGAUGUGAUCCUUGAGC | 627 |
| GUUAUCGUUUCCAGAACAGU | 628 |
| GGUUAUCGUUUCCAGAACAG | 629 |
| UGGUUAUCGUUUCCAGAACA | 630 |
| UUGGUUAUCGUUUCCAGAAC | 631 |
| UAACCAUUAGCCAAGUCCUC | 632 |
| UUAACCAUUAGCCAAGUCCU | 633 |
| AUUAACCAUUAGCCAAGUCC | 634 |
| AUUACAGGCGUGAGCCACCG | 635 |
| GAUUACAGGCGUGAGCCACC | 636 |
| GGAUUACAGGCGUGAGCCAC | 637 |
| GGGAUUACAGGCGUGAGCCA | 638 |
| UGGGAUUACAGGCGUGAGCC | 639 |
| CUGGGAUUACAGGCGUGAGC | 640 |
| GCUGGGAUUACAGGCGUGAG | 641 |
| UGCUGGGAUUACAGGCGUGA | 642 |
| GUGCUGGGAUUACAGGCGUG | 643 |
| AGUGCUGGGAUUACAGGCGU | 644 |
| AAGUGCUGGGAUUACAGGCG | 645 |
| AAAGUGCUGGGAUUACAGGC | 646 |
| CAAAGUGCUGGGAUUACAGG | 647 |
| CCAAAGUGCUGGGAUUACAG | 648 |
| UCUCAGCCUCCCAAAGUGCU | 649 |
| UUCUCAGCCUCCCAAAGUGC | 650 |
| CUUCUCAGCCUCCCAAAGUG | 651 |
| CCUUCUCAGCCUCCCAAAGU | 652 |
| CCCUUCUCAGCCUCCCAAAG | 653 |
| AUCUCCUGACCUCGUGAUCC | 654 |

| Sequence | SEQ ID NO: |
|---|---|
| CAUCUCCUGACCUCGUGAUC | 655 |
| CCAUCUCCUGACCUCGUGAU | 656 |
| UCCAUCUCCUGACCUCGUGA | 657 |
| CUCCAUCUCCUGACCUCGUG | 658 |
| UCUCCAUCUCCUGACCUCGU | 659 |
| CUCACCGUGUUAGCCAGGAU | 660 |
| UCUCACCGUGUUAGCCAGGA | 661 |
| GUCUCACCGUGUUAGCCAGG | 662 |
| GGUCUCACCGUGUUAGCCAG | 663 |
| GGGUCUCACCGUGUUAGCCA | 664 |
| UACAGGCACCUGCCACCAUG | 665 |
| CUACAGGCACCUGCCACCAU | 666 |
| ACUACAGGCACCUGCCACCA | 667 |
| AGCUGGGACUACAGGCACCU | 668 |
| UAGCUGGGACUACAGGCACC | 669 |
| CUGCCGAGUAGCUGGGACUA | 670 |
| CUCACUGCAAGCUCCACCUC | 671 |
| GCUCACUGCAAGCUCCACCU | 672 |
| UCGGCUCACUGCAAGCUCCA | 673 |
| UCUCGGCUCACUGCAAGCUC | 674 |
| AUCUCGGCUCACUGCAAGCU | 675 |
| AAUCUCGGCUCACUGCAAGC | 676 |
| CAAUCUCGGCUCACUGCAAG | 677 |
| GCAAUCUCGGCUCACUGCAA | 678 |
| GUGCAAUCUCGGCUCACUGC | 679 |
| GGUGCAAUCUCGGCUCACUG | 680 |
| UGGUGCAAUCUCGGCUCACU | 681 |
| GUGGUGCAAUCUCGGCUCAC | 682 |
| AGUGGUGCAAUCUCGGCUCA | 683 |
| CAGUGGUGCAAUCUCGGCUC | 684 |
| GCAGUGGUGCAAUCUCGGCU | 685 |
| AGGCUGGAAUGCAGUGGUGC | 686 |
| CAGGCUGGAAUGCAGUGGUG | 687 |
| CCAGGCUGGAAUGCAGUGGU | 688 |
| ACCCAGGCUGGAAUGCAGUG | 689 |
| CACCCAGGCUGGAAUGCAGU | 690 |
| UCACCCAGGCUGGAAUGCAG | 691 |
| GUCACCCAGGCUGGAAUGCA | 692 |
| AGUCACCCAGGCUGGAAUGC | 693 |

TABLE 2-continued

| Sequence | SEQ ID NO: |
|---|---|
| CAGUCACCCAGGCUGGAAUG | 694 |
| UCAGUCACCCAGGCUGGAAU | 695 |
| CUCAGUCACCCAGGCUGGAA | 696 |
| GACAGAGUCUCGCUCAGUCA | 697 |
| GUCAUGUCUGAUGUACCUUU | 698 |
| AGUCAUGUCUGAUGUACCUU | 699 |
| CAGUCAUGUCUGAUGUACCU | 700 |
| GCAGUCAUGUCUGAUGUACC | 701 |
| GGCAGUCAUGUCUGAUGUAC | 702 |
| AGGCAGUCAUGUCUGAUGUA | 703 |
| CAGGCAGUCAUGUCUGAUGU | 704 |
| GCAGGCAGUCAUGUCUGAUG | 705 |
| UGCAGGCAGUCAUGUCUGAU | 706 |
| CUGUUUGACUUCAUGCAGGC | 707 |
| UACCCUGUUUGACUUCAUGC | 708 |
| GUUACCCUGUUUGACUUCAU | 709 |
| GGUGUUACCCUGUUUGACUU | 710 |
| UGGUGUUACCCUGUUUGACU | 711 |
| CUGGUGUUACCCUGUUUGAC | 712 |
| ACUGGUGUUACCCUGUUUGA | 713 |
| CACUGGUGUUACCCUGUUUG | 714 |
| UCACUGGUGUUACCCUGUUU | 715 |
| UUCACUGGUGUUACCCUGUU | 716 |
| CUUCACUGGUGUUACCCUGU | 717 |
| AGCUUCACUGGUGUUACCCU | 718 |
| UUGAGCUUCACUGGUGUUAC | 719 |
| CUUGAGCUUCACUGGUGUUA | 720 |
| ACUUGAGCUUCACUGGUGUU | 721 |
| GACUUGAGCUUCACUGGUGU | 722 |
| CUCUUGACUUGAGCUUCACU | 723 |
| UCCACAGCUCUUGACUUGAG | 724 |
| AUCCACAGCUCUUGACUUGA | 725 |
| UAUCCACAGCUCUUGACUUG | 726 |
| GACAAAAUAUCCACAGCUCU | 727 |
| AGACAAAAUAUCCACAGCUC | 728 |
| GACUUCUUGUUGGUUAGACA | 729 |
| UGAGACUUCUUGUUGGUUAG | 730 |
| CUUGAGACUUCUUGUUGGUU | 731 |
| UCUUGAGACUUCUUGUUGGU | 732 |

TABLE 2-continued

| Sequence | SEQ ID NO: |
|---|---|
| UUCUUGAGACUUCUUGUUGG | 733 |
| GCCUGAUUUCUUGAGACUUC | 734 |
| UGCCUGAUUUCUUGAGACUU | 735 |
| CAUCUUUUGGCUGGAUACGA | 736 |
| GCAUCUUUUGGCUGGAUACG | 737 |
| CCACCACUCCAUCAUCAUGC | 738 |
| CCCACCACUCCAUCAUCAUG | 739 |
| GAUACUGAACUGGCCUUCCC | 740 |
| UAGGAUACUGAACUGGCCUU | 741 |
| AUAGGAUACUGAACUGGCCU | 742 |
| AAUAGGAUACUGAACUGGCC | 743 |
| AAAUAGGAUACUGAACUGGC | 744 |
| GGAGAAAGUCACUUGAGGCU | 745 |
| UGGAGAAAGUCACUUGAGGC | 746 |
| AAUGGAGAAAGUCACUUGAG | 747 |
| AGCAAUGGAGAAAGUCACUU | 748 |
| UAGCGUGAAGCAAUGGAGAA | 749 |
| AUAGCGUGAAGCAAUGGAGA | 750 |
| CAUAGCGUGAAGCAAUGGAG | 751 |
| GCAUAGCGUGAAGCAAUGGA | 752 |
| GGCAUAGCGUGAAGCAAUGG | 753 |
| UGGCAUAGCGUGAAGCAAUG | 754 |
| GUGGCAUAGCGUGAAGCAAU | 755 |
| AGUGGCAUAGCGUGAAGCAA | 756 |
| UAGUGGCAUAGCGUGAAGCA | 757 |
| AUAGUGGCAUAGCGUGAAGC | 758 |
| AAUAGUGGCAUAGCGUGAAG | 759 |
| AAAUAGUGGCAUAGCGUGAA | 760 |
| AAAAUAGUGGCAUAGCGUGA | 761 |
| GCAAAAUAGUGGCAUAGCGU | 762 |
| AGCAAAAUAGUGGCAUAGCG | 763 |
| AAGCAAAAUAGUGGCAUAGC | 764 |
| AACUGGUUGGGCAAACUAUA | 765 |
| AAACUGGUUGGGCAAACUAU | 766 |
| AAAACUGGUUGGGCAAACUA | 767 |
| UAAAACUGGUUGGGCAAACU | 768 |
| GUAAAACUGGUUGGGCAAAC | 769 |
| CGUAAAACUGGUUGGGCAAA | 770 |
| GACGUAAAACUGGUUGGGCA | 771 |

37

38

TABLE 2-continued

TABLE 2-continued

| Sequence | SEQ ID NO: |
| --- | --- |
| GGACGUAAAACUGGUUGGGC | 772 |
| UGGACGUAAAACUGGUUGGG | 773 |
| UUGGACGUAAAACUGGUUGG | 774 |
| CUUGGACGUAAAACUGGUUG | 775 |
| CCUUGGACGUAAAACUGGUU | 776 |
| UCCUUGGACGUAAAACUGGU | 777 |
| UUCCUUGGACGUAAAACUGG | 778 |
| UUUCCUUGGACGUAAAACUG | 779 |
| GGCUAAUUUUCCUUGGACGU | 780 |
| UGGCUAAUUUUCCUUGGACG | 781 |
| GCAUUGGCUAAUUUUCCUUG | 782 |
| UUCCUGAUCCUUGCCUUUCA | 783 |
| UCUGGUUUCCUGAUCCUUGC | 784 |
| UCUCUGGUUUCCUGAUCCUU | 785 |
| GUCUCUGGUUUCCUGAUCCU | 786 |
| AGUCUCUGGUUUCCUGAUCC | 787 |
| AAGUCUCUGGUUUCCUGAUC | 788 |
| CCUGACACCUAGUUUCUAAU | 789 |
| AACCCUGACACCUAGUUUCU | 790 |
| AUAAACCCUGACACCUAGUU | 791 |
| GAUAAACCCUGACACCUAGU | 792 |
| UGAUAAACCCUGACACCUAG | 793 |
| CUUGAUAAACCCUGACACCU | 794 |
| UCUUGAUAAACCCUGACACC | 795 |
| UUCUUGAUAAACCCUGACAC | 796 |
| CUUCUUGAUAAACCCUGACA | 797 |
| CCUUCUUGAUAAACCCUGAC | 798 |
| GCCUUCUUGAUAAACCCUGA | 799 |
| GGCCUUCUUGAUAAACCCUG | 800 |
| UGGCCUUCUUGAUAAACCCU | 801 |
| UUCCUGGCCUUCUUGAUAAA | 802 |
| CAGAGACCAUUCAUUUGGAA | 803 |
| CCAGAGACCAUUCAUUUGGA | 804 |
| ACCAGAGACCAUUCAUUUGG | 805 |
| UGACCAGAGACCAUUCAUUU | 806 |
| UUGACCAGAGACCAUUCAUU | 807 |
| UUUGACCAGAGACCAUUCAU | 808 |
| AUUUGACCAGAGACCAUUCA | 809 |
| CAUUUGACCAGAGACCAUUC | 810 |

| Sequence | SEQ ID NO: |
| --- | --- |
| AUUCAUUUGACCAGAGACCA | 811 |
| UUGUAUCUCUGUGAGGGCAG | 812 |
| GUAAGGCUUAAACCAAAUGG | 813 |
| CAGAUUCGACUUCAUUUGGA | 814 |
| GGCAGAUUCGACUUCAUUUG | 815 |
| GGGCAGAUUCGACUUCAUUU | 816 |
| AGGGCAGAUUCGACUUCAUU | 817 |
| GAGGGCAGAUUCGACUUCAU | 818 |
| UGAGGGCAGAUUCGACUUCA | 819 |
| GUGAGGGCAGAUUCGACUUC | 820 |
| UGUGAGGGCAGAUUCGACUU | 821 |
| CUGUGAGGGCAGAUUCGACU | 822 |
| CUUGUGUCUCUGUGAGGGCA | 823 |
| UUCUUGUGUCUCUGUGAGGG | 824 |
| AUUUCAGAGAGCAAGAAGCG | 825 |
| CAUUUCAGAGAGCAAGAAGC | 826 |
| GGCAUUUCAGAGAGCAAGAA | 827 |
| CAUUUAGCAGGGCAUUUCAG | 828 |
| GCAUUUAGCAGGGCAUUUCA | 829 |
| AGCAUUUAGCAGGGCAUUUC | 830 |
| AGAAGCAUUUAGCAGGGCAU | 831 |
| GAGAAGCAUUUAGCAGGGCA | 832 |
| CUCUUGACCCAACAUCCCAA | 833 |
| CCUCUUGACCCAACAUCCCA | 834 |
| UGGAUUGACUAACACUUUCC | 835 |
| GUGGAUUGACUAACACUUUC | 836 |
| CUGUGGCAUCAAAGAAAGGU | 837 |
| UCUGACUGUGGCAUCAAAGA | 838 |
| UCUCUGACUGUGGCAUCAAA | 839 |
| GGCCACCCAAACUGUAUUCU | 840 |
| ACCACCAAGUCAAAGUUAGA | 841 |
| CACCACCAAGUCAAAGUUAG | 842 |
| GUCCACCACCAAGUCAAAGU | 843 |
| GGUCCACCACCAAGUCAAAG | 844 |
| AGGAAGGUCCACCACCAAGU | 845 |
| AAGGAAGGUCCACCACCAAG | 846 |
| CAAGGAAGGUCCACCACCAA | 847 |
| CCAAGGAAGGUCCACCACCA | 848 |
| ACCAAGGAAGGUCCACCACC | 849 |

TABLE 2-continued

| Sequence | SEQ ID NO: |
|---|---|
| AACCAAGGAAGGUCCACCAC | 850 |
| AAACCAAGGAAGGUCCACCA | 851 |
| GUUGAUGGUACAGUUCUACU | 852 |
| UGUUGAUGGUACAGUUCUAC | 853 |
| CAUUGUUGAUGGUACAGUUC | 854 |

TABLE 2-continued

| Sequence | SEQ ID NO: |
|---|---|
| GGAAACAUUGUUGAUGGUAC | 855 |
| GUAUUGGCACAGUAAUUCUC | 856 |
| CAGUAUUGGCACAGUAAUUC | 857 |
| UCAAAACAGUAUUGGCACAG | 858 |

In some embodiments, the siRNA molecules targeted to ERAP2 comprise or consist of the nucleotide sequences (sense and antisense strands) shown in Table 3.

TABLE 3

| Sense Sequence | SEQ ID NO: | Antisense Sequence | SEQ ID NO: |
|---|---|---|---|
| AAAGAUCACAGAAGCUGCC | 859 | GGCAGCUUCUGUGAUCUUU | 860 |
| AAGAUCACAGAAGCUGCCC | 861 | GGGCAGCUUCUGUGAUCUU | 862 |
| AGAUCACAGAAGCUGCCCG | 863 | CGGGCAGCUUCUGUGAUCU | 864 |
| CCGGGAGGUGUUUGAUUAA | 865 | UUAAUCAAACACCUCCCGG | 866 |
| CGGGAGGUGUUUGAUUAAA | 867 | UUUAAUCAAACACCUCCCG | 868 |
| GGGAGGUGUUUGAUUAAAU | 869 | AUUUAAUCAAACACCUCCC | 870 |
| GGAGGUGUUUGAUUAAAUU | 871 | AAUUUAAUCAAACACCUCC | 872 |
| GAGGUGUUUGAUUAAAUUC | 873 | GAAUUUAAUCAAACACCUC | 874 |
| AUGUGACAUAACUGGAGCC | 875 | GGCUCCAGUUAUGUCACAU | 876 |
| UGUGACAUAACUGGAGCCA | 877 | UGGCUCCAGUUAUGUCACA | 878 |
| UGGAGCCAGUGCAGUGCCA | 879 | UGGCACUGCACUGGCUCCA | 880 |
| GCCAGUGCAGUGCCAUGAA | 881 | UUCAUGGCACUGCACUGGC | 882 |
| CCAGUGCAGUGCCAUGAAG | 883 | CUUCAUGGCACUGCACUGG | 884 |
| CAGUGCAGUGCCAUGAAGA | 885 | UCUUCAUGGCACUGCACUG | 886 |
| AGUGCAGUGCCAUGAAGAA | 887 | UUCUUCAUGGCACUGCACU | 888 |
| AGAUUAGCCUGGAUAUUAA | 889 | UUAAUAUCCAGGCUAAUCU | 890 |
| GAUUAGCCUGGAUAUUAAC | 891 | GUUAAUAUCCAGGCUAAUC | 892 |
| AUUAGCCUGGAUAUUAACU | 893 | AGUUAAUAUCCAGGCUAAU | 894 |
| UUAGCCUGGAUAUUAACUU | 895 | AAGUUAAUAUCCAGGCUAA | 896 |
| UAGCCUGGAUAUUAACUUG | 897 | CAAGUUAAUAUCCAGGCUA | 898 |
| GCCUGGAUAUUAACUUGUC | 899 | GACAAGUUAAUAUCCAGGC | 900 |
| CCUGGAUAUUAACUUGUCU | 901 | AGACAAGUUAAUAUCCAGG | 902 |
| CUGGAUAUUAACUUGUCUU | 903 | AAGACAAGUUAAUAUCCAG | 904 |
| UGGAUAUUAACUUGUCUUC | 905 | GAAGACAAGUUAAUAUCCA | 906 |
| GGAUAUUAACUUGUCUUCU | 907 | AGAAGACAAGUUAAUAUCC | 908 |
| AUUAACUUGUCUUCUAGAG | 909 | CUCUAGAAGACAAGUUAAU | 910 |
| AGAAUAGAUUUCAUGUUCC | 911 | GGAACAUGAAAUCUAUUCU | 912 |
| GAAUAGAUUUCAUGUUCCA | 913 | UGGAACAUGAAAUCUAUUC | 914 |
| UAGAUUUCAUGUUCCAUUC | 915 | GAAUGGAACAUGAAAUCUA | 916 |
| GAUUUCAUGUUCCAUUCUU | 917 | AAGAAUGGAACAUGAAAUC | 918 |

TABLE 3-continued

| Sense Sequence | SEQ ID NO: | Antisense Sequence | SEQ ID NO: |
|---|---|---|---|
| AUUUCAUGUUCCAUUCUUC | 919 | GAAGAAUGGAACAUGAAAU | 920 |
| UUUCAUGUUCCAUUCUUCU | 921 | AGAAGAAUGGAACAUGAAA | 922 |
| UUCAUGUUCCAUUCUUCUG | 923 | CAGAAGAAUGGAACAUGAA | 924 |
| UCAUGUUCCAUUCUUCUGC | 925 | GCAGAAGAAUGGAACAUGA | 926 |
| CAUGUUCCAUUCUUCUGCA | 927 | UGCAGAAGAAUGGAACAUG | 928 |
| UCUUCUGCAAUGGUUAAUU | 929 | AAUUAACCAUUGCAGAAGA | 930 |
| UUCUGCAAUGGUUAAUUCA | 931 | UGAAUUAACCAUUGCAGAA | 932 |
| CAUUCACAGAGGAUUUUAC | 933 | GUAAAAUCCUCUGUGAAUG | 934 |
| AUUCACAGAGGAUUUUACU | 935 | AGUAAAAUCCUCUGUGAAU | 936 |
| ACAGAGGAUUUUACUGCUU | 937 | AAGCAGUAAAAUCCUCUGU | 938 |
| CAGAGGAUUUUACUGCUUA | 939 | UAAGCAGUAAAAUCCUCUG | 940 |
| AGAGGAUUUUACUGCUUAA | 941 | UUAAGCAGUAAAAUCCUCU | 942 |
| GAGGAUUUUACUGCUUAAC | 943 | GUUAAGCAGUAAAAUCCUC | 944 |
| AUAUGCAUUUGUUCUCAGU | 945 | ACUGAGAACAAAUGCAUAU | 946 |
| AUGCAUUUGUUCUCAGUUC | 947 | GAACUGAGAACAAAUGCAU | 948 |
| UUUGUUCUCAGUUCUCAGU | 949 | ACUGAGAACUGAGAACAAA | 950 |
| UUGUUCUCAGUUCUCAGUG | 951 | CACUGAGAACUGAGAACAA | 952 |
| GUUCUCAGUUCUCAGUGCC | 953 | GGCACUGAGAACUGAGAAC | 954 |
| UUCUCAGUUCUCAGUGCCA | 955 | UGGCACUGAGAACUGAGAA | 956 |
| CAGUUCUCAGUGCCAUCUA | 957 | UAGAUGGCACUGAGAACUG | 958 |
| AGUUCUCAGUGCCAUCUAG | 959 | CUAGAUGGCACUGAGAACU | 960 |
| UCAGUGCCAUCUAGUUAUC | 961 | GAUAACUAGAUGGCACUGA | 962 |
| CAGUGCCAUCUAGUUAUCA | 963 | UGAUAACUAGAUGGCACUG | 964 |
| AGUGCCAUCUAGUUAUCAC | 965 | GUGAUAACUAGAUGGCACU | 966 |
| GUGCCAUCUAGUUAUCACU | 967 | AGUGAUAACUAGAUGGCAC | 968 |
| UGCCAUCUAGUUAUCACUU | 969 | AAGUGAUAACUAGAUGGCA | 970 |
| GCCAUCUAGUUAUCACUUC | 971 | GAAGUGAUAACUAGAUGGC | 972 |
| CCAUCUAGUUAUCACUUCA | 973 | UGAAGUGAUAACUAGAUGG | 974 |
| CAUCUAGUUAUCACUUCAC | 975 | GUGAAGUGAUAACUAGAUG | 976 |
| AUCUAGUUAUCACUUCACU | 977 | AGUGAAGUGAUAACUAGAU | 978 |
| UCUAGUUAUCACUUCACUG | 979 | CAGUGAAGUGAUAACUAGA | 980 |
| CUAGUUAUCACUUCACUGA | 981 | UCAGUGAAGUGAUAACUAG | 982 |
| UAGUUAUCACUUCACUGAG | 983 | CUCAGUGAAGUGAUAACUA | 984 |
| AGUUAUCACUUCACUGAGG | 985 | CCUCAGUGAAGUGAUAACU | 986 |
| GUUAUCACUUCACUGAGGA | 987 | UCCUCAGUGAAGUGAUAAC | 988 |
| UUAUCACUUCACUGAGGAU | 989 | AUCCUCAGUGAAGUGAUAA | 990 |
| UAUCACUUCACUGAGGAUC | 991 | GAUCCUCAGUGAAGUGAUA | 992 |
| AUCACUUCACUGAGGAUCC | 993 | GGAUCCUCAGUGAAGUGAU | 994 |
| UCACUUCACUGAGGAUCCU | 995 | AGGAUCCUCAGUGAAGUGA | 996 |

TABLE 3-continued

| Sense Sequence | SEQ ID NO: | Antisense Sequence | SEQ ID NO: |
|---|---|---|---|
| GCUUUCCCAGUAGCCACUA | 997 | UAGUGGCUACUGGGAAAGC | 998 |
| CUUUCCCAGUAGCCACUAA | 999 | UUAGUGGCUACUGGGAAAG | 1000 |
| UUUCCCAGUAGCCACUAAU | 1001 | AUUAGUGGCUACUGGGAAA | 1002 |
| UUCCCAGUAGCCACUAAUG | 1003 | CAUUAGUGGCUACUGGGAA | 1004 |
| UCCCAGUAGCCACUAAUGG | 1005 | CCAUUAGUGGCUACUGGGA | 1006 |
| CUUGGCAGGAGCUAAGGCU | 1007 | AGCCUUAGCUCCUGCCAAG | 1008 |

In some embodiments, the siRNA molecules targeted to ERAP2 comprise or consist of the nucleotide sequences (sense and antisense strands) shown in Table 4.

TABLE 4

| Sense Sequence | SEQ ID NO: | Antisense Sequence | SEQ ID NO: |
|---|---|---|---|
| UCAAAUCUGCAGCAGCAUG | 1009 | CAUGCUGCUGCAGAUUUGA | 1010 |
| CAAAUCUGCAGCAGCAUGA | 1011 | UCAUGCUGCUGCAGAUUUG | 1012 |
| AAAUCUGCAGCAGCAUGAU | 1013 | AUCAUGCUGCUGCAGAUUU | 1014 |
| AUGUGACAUAACUGGAGCC | 1015 | GGCUCCAGUUAUGUCACAU | 1016 |
| UGUGACAUAACUGGAGCCA | 1017 | UGGCUCCAGUUAUGUCACA | 1018 |
| UGGAGCCAGUGCAGUGCCA | 1019 | UGGCACUGCACUGGCUCCA | 1020 |
| GCCAGUGCAGUGCCAUGAA | 1021 | UUCAUGGCACUGCACUGGC | 1022 |
| CCAGUGCAGUGCCAUGAAG | 1023 | CUUCAUGGCACUGCACUGG | 1024 |
| CAGUGCAGUGCCAUGAAGA | 1025 | UCUUCAUGGCACUGCACUG | 1026 |
| AGUGCAGUGCCAUGAAGAA | 1027 | UUCUUCAUGGCACUGCACU | 1028 |
| AGAUUAGCCUGGAUAUUAA | 1029 | UUAAUAUCCAGGCUAAUCU | 1030 |
| GAUUAGCCUGGAUAUUAAC | 1031 | GUUAAUAUCCAGGCUAAUC | 1032 |
| AUUAGCCUGGAUAUUAACU | 1033 | AGUUAAUAUCCAGGCUAAU | 1034 |
| UUAGCCUGGAUAUUAACUU | 1035 | AAGUUAAUAUCCAGGCUAA | 1036 |
| UAGCCUGGAUAUUAACUUG | 1037 | CAAGUUAAUAUCCAGGCUA | 1038 |
| GCCUGGAUAUUAACUUGUC | 1039 | GACAAGUUAAUAUCCAGGC | 1040 |
| CCUGGAUAUUAACUUGUCU | 1041 | AGACAAGUUAAUAUCCAGG | 1042 |
| CUGGAUAUUAACUUGUCUU | 1043 | AAGACAAGUUAAUAUCCAG | 1044 |
| UGGAUAUUAACUUGUCUUC | 1045 | GAAGACAAGUUAAUAUCCA | 1046 |
| GGAUAUUAACUUGUCUUCU | 1047 | AGAAGACAAGUUAAUAUCC | 1048 |
| AUUAACUUGUCUUCUAGAG | 1049 | CUCUAGAAGACAAGUUAAU | 1050 |
| AGAAUAGAUUUCAUGUUCC | 1051 | GGAACAUGAAAUCUAUUCU | 1052 |
| GAAUAGAUUUCAUGUUCCA | 1053 | UGGAACAUGAAAUCUAUUC | 1054 |
| UAGAUUUCAUGUUCCAUUC | 1055 | GAAUGGAACAUGAAAUCUA | 1056 |
| GAUUUCAUGUUCCAUUCUU | 1057 | AAGAAUGGAACAUGAAAUC | 1058 |
| AUUUCAUGUUCCAUUCUUC | 1059 | GAAGAAUGGAACAUGAAAU | 1060 |
| UUUCAUGUUCCAUUCUUCU | 1061 | AGAAGAAUGGAACAUGAAA | 1062 |
| UUCAUGUUCCAUUCUUCUG | 1063 | CAGAAGAAUGGAACAUGAA | 1064 |

TABLE 4-continued

| Sense Sequence | SEQ ID NO: | Antisense Sequence | SEQ ID NO: |
|---|---|---|---|
| UCAUGUUCCAUUCUUCUGC | 1065 | GCAGAAGAAUGGAACAUGA | 1066 |
| CAUGUUCCAUUCUUCUGCA | 1067 | UGCAGAAGAAUGGAACAUG | 1068 |
| UCUUCUGCAAUGGUUAAUU | 1069 | AAUUAACCAUUGCAGAAGA | 1070 |
| UUCUGCAAUGGUUAAUUCA | 1071 | UGAAUUAACCAUUGCAGAA | 1072 |
| CAUUCACAGAGGAUUUUAC | 1073 | GUAAAAUCCUCUGUGAAUG | 1074 |
| AUUCACAGAGGAUUUUACU | 1075 | AGUAAAAUCCUCUGUGAAU | 1076 |
| ACAGAGGAUUUUACUGCUU | 1077 | AAGCAGUAAAAUCCUCUGU | 1078 |
| CAGAGGAUUUUACUGCUUA | 1079 | UAAGCAGUAAAAUCCUCUG | 1080 |
| AGAGGAUUUUACUGCUUAA | 1081 | UUAAGCAGUAAAAUCCUCU | 1082 |
| GAGGAUUUUACUGCUUAAC | 1083 | GUUAAGCAGUAAAAUCCUC | 1084 |
| AUAUGCAUUUGUUCUCAGU | 1085 | ACUGAGAACAAAUGCAUAU | 1086 |
| AUGCAUUUGUUCUCAGUUC | 1087 | GAACUGAGAACAAAUGCAU | 1088 |
| UUUGUUCUCAGUUCUCAGU | 1089 | ACUGAGAACUGAGAACAAA | 1090 |
| UUGUUCUCAGUUCUCAGUG | 1091 | CACUGAGAACUGAGAACAA | 1092 |
| GUUCUCAGUUCUCAGUGCC | 1093 | GGCACUGAGAACUGAGAAC | 1094 |
| UUCUCAGUUCUCAGUGCCA | 1095 | UGGCACUGAGAACUGAGAA | 1096 |
| CAGUUCUCAGUGCCAUCUA | 1097 | UAGAUGGCACUGAGAACUG | 1098 |
| AGUUCUCAGUGCCAUCUAG | 1099 | CUAGAUGGCACUGAGAACU | 1100 |
| UCAGUGCCAUCUAGUUAUC | 1101 | GAUAACUAGAUGGCACUGA | 1102 |
| CAGUGCCAUCUAGUUAUCA | 1103 | UGAUAACUAGAUGGCACUG | 1104 |
| AGUGCCAUCUAGUUAUCAC | 1105 | GUGAUAACUAGAUGGCACU | 1106 |
| GUGCCAUCUAGUUAUCACU | 1107 | AGUGAUAACUAGAUGGCAC | 1108 |
| UGCCAUCUAGUUAUCACUU | 1109 | AAGUGAUAACUAGAUGGCA | 1110 |
| GCCAUCUAGUUAUCACUUC | 1111 | GAAGUGAUAACUAGAUGGC | 1112 |
| CCAUCUAGUUAUCACUUCA | 1113 | UGAAGUGAUAACUAGAUGG | 1114 |
| CAUCUAGUUAUCACUUCAC | 1115 | GUGAAGUGAUAACUAGAUG | 1116 |
| AUCUAGUUAUCACUUCACU | 1117 | AGUGAAGUGAUAACUAGAU | 1118 |
| UCUAGUUAUCACUUCACUG | 1119 | CAGUGAAGUGAUAACUAGA | 1120 |
| CUAGUUAUCACUUCACUGA | 1121 | UCAGUGAAGUGAUAACUAG | 1122 |
| UAGUUAUCACUUCACUGAG | 1123 | CUCAGUGAAGUGAUAACUA | 1124 |
| AGUUAUCACUUCACUGAGG | 1125 | CCUCAGUGAAGUGAUAACU | 1126 |
| GUUAUCACUUCACUGAGGA | 1127 | UCCUCAGUGAAGUGAUAAC | 1128 |
| UUAUCACUUCACUGAGGAU | 1129 | AUCCUCAGUGAAGUGAUAA | 1130 |
| UAUCACUUCACUGAGGAUC | 1131 | GAUCCUCAGUGAAGUGAUA | 1132 |
| AUCACUUCACUGAGGAUCC | 1133 | GGAUCCUCAGUGAAGUGAU | 1134 |
| UCACUUCACUGAGGAUCCU | 1135 | AGGAUCCUCAGUGAAGUGA | 1136 |
| GCUUUCCCAGUAGCCACUA | 1137 | UAGUGGCUACUGGGAAAGC | 1138 |
| CUUUCCCAGUAGCCACUAA | 1139 | UUAGUGGCUACUGGGAAAG | 1140 |
| UUUCCCAGUAGCCACUAAU | 1141 | AUUAGUGGCUACUGGGAAA | 1142 |

TABLE 4-continued

| Sense Sequence | SEQ ID NO: | Antisense Sequence | SEQ ID NO: |
|---|---|---|---|
| UUCCCAGUAGCCACUAAUG | 1143 | CAUUAGUGGCUACUGGGAA | 1144 |
| UCCCAGUAGCCACUAAUGG | 1145 | CCAUUAGUGGCUACUGGGA | 1146 |
| CUUGGCAGGAGCUAAGGCU | 1147 | AGCCUUAGCUCCUGCCAAG | 1148 |
| CCAGUGUGGUCAUUCCUCU | 1149 | AGAGGAAUGACCACACUGG | 1150 |
| GUCAUUCCUCUCCAUUAUG | 1151 | CAUAAUGGAGAGGAAUGAC | 1152 |
| CAUUCCUCUCCAUUAUGAC | 1153 | GUCAUAAUGGAGAGGAAUG | 1154 |
| AUUCCUCUCCAUUAUGACC | 1155 | GGUCAUAAUGGAGAGGAAU | 1156 |
| CUCUCCAUUAUGACCUCUU | 1157 | AAGAGGUCAUAAUGGAGAG | 1158 |
| UCUCCAUUAUGACCUCUUU | 1159 | AAAGAGGUCAUAAUGGAGA | 1160 |
| CUCCAUUAUGACCUCUUUG | 1161 | CAAAGAGGUCAUAAUGGAG | 1162 |
| UCCAUUAUGACCUCUUUGU | 1163 | ACAAAGAGGUCAUAAUGGA | 1164 |
| CCAUUAUGACCUCUUUGUC | 1165 | GACAAAGAGGUCAUAAUGG | 1166 |
| CAUUAUGACCUCUUUGUCC | 1167 | GGACAAAGAGGUCAUAAUG | 1168 |
| CCCAAUCUCACCUCUCUGG | 1169 | CCAGAGAGGUGAGAUUGGG | 1170 |
| UCUCACCUCUCUGGACUUU | 1171 | AAAGUCCAGAGAGGUGAGA | 1172 |
| CUCACCUCUCUGGACUUUG | 1173 | CAAAGUCCAGAGAGGUGAG | 1174 |
| UCACCUCUCUGGACUUUGU | 1175 | ACAAAGUCCAGAGAGGUGA | 1176 |
| UCUCUGGACUUUGUUGCAU | 1177 | AUGCAACAAAGUCCAGAGA | 1178 |
| CUCUGGACUUUGUUGCAUC | 1179 | GAUGCAACAAAGUCCAGAG | 1180 |
| CUGGACUUUGUUGCAUCUG | 1181 | CAGAUGCAACAAAGUCCAG | 1182 |
| GGACUUUGUUGCAUCUGAG | 1183 | CUCAGAUGCAACAAAGUCC | 1184 |
| GAAGUCUUGGUCAGCAAUG | 1185 | CAUUGCUGACCAAGACUUC | 1186 |
| AAGUCUUGGUCAGCAAUGC | 1187 | GCAUUGCUGACCAAGACUU | 1188 |
| AGUCUUGGUCAGCAAUGCU | 1189 | AGCAUUGCUGACCAAGACU | 1190 |
| GUCUUGGUCAGCAAUGCUA | 1191 | UAGCAUUGCUGACCAAGAC | 1192 |
| UCUUGGUCAGCAAUGCUAC | 1193 | GUAGCAUUGCUGACCAAGA | 1194 |
| CUUGGUCAGCAAUGCUACC | 1195 | GGUAGCAUUGCUGACCAAG | 1196 |
| UUGGUCAGCAAUGCUACCC | 1197 | GGGUAGCAUUGCUGACCAA | 1198 |
| UGGUCAGCAAUGCUACCCA | 1199 | UGGGUAGCAUUGCUGACCA | 1200 |
| GGUCAGCAAUGCUACCCAG | 1201 | CUGGGUAGCAUUGCUGACC | 1202 |
| GUCAGCAAUGCUACCCAGU | 1203 | ACUGGGUAGCAUUGCUGAC | 1204 |
| UCAGCAAUGCUACCCAGUU | 1205 | AACUGGGUAGCAUUGCUGA | 1206 |
| CAGCAAUGCUACCCAGUUU | 1207 | AAACUGGGUAGCAUUGCUG | 1208 |
| AGCAAUGCUACCCAGUUUA | 1209 | UAAACUGGGUAGCAUUGCU | 1210 |
| CAAUGCUACCCAGUUUAUC | 1211 | GAUAAACUGGGUAGCAUUG | 1212 |
| AAUGCUACCCAGUUUAUCA | 1213 | UGAUAAACUGGGUAGCAUU | 1214 |
| AUGCUACCCAGUUUAUCAU | 1215 | AUGAUAAACUGGGUAGCAU | 1216 |
| UGCUACCCAGUUUAUCAUC | 1217 | GAUGAUAAACUGGGUAGCA | 1218 |
| GCUACCCAGUUUAUCAUCU | 1219 | AGAUGAUAAACUGGGUAGC | 1220 |

TABLE 4-continued

| Sense Sequence | SEQ ID NO: | Antisense Sequence | SEQ ID NO: |
|---|---|---|---|
| CUACCCAGUUUAUCAUCUU | 1221 | AAGAUGAUAAACUGGGUAG | 1222 |
| UACCCAGUUUAUCAUCUUG | 1223 | CAAGAUGAUAAACUGGGUA | 1224 |
| ACCCAGUUUAUCAUCUUGC | 1225 | GCAAGAUGAUAAACUGGGU | 1226 |
| CCCAGUUUAUCAUCUUGCA | 1227 | UGCAAGAUGAUAAACUGGG | 1228 |
| GUUUAUCAUCUUGCACAGC | 1229 | GCUGUGCAAGAUGAUAAAC | 1230 |
| UUUAUCAUCUUGCACAGCA | 1231 | UGCUGUGCAAGAUGAUAAA | 1232 |
| UCACGAAUGCCACCCUUCA | 1233 | UGAAGGGUGGCAUUCGUGA | 1234 |
| CACGAAUGCCACCCUUCAG | 1235 | CUGAAGGGUGGCAUUCGUG | 1236 |
| ACGAAUGCCACCCUUCAGU | 1237 | ACUGAAGGGUGGCAUUCGU | 1238 |
| CGAAUGCCACCCUUCAGUC | 1239 | GACUGAAGGGUGGCAUUCG | 1240 |
| GAAUGCCACCCUUCAGUCA | 1241 | UGACUGAAGGGUGGCAUUC | 1242 |
| UUCAGUCAGAGGAAGAUUC | 1243 | GAAUCUUCCUCUGACUGAA | 1244 |
| UCAGUCAGAGGAAGAUUCA | 1245 | UGAAUCUUCCUCUGACUGA | 1246 |
| CAGUCAGAGGAAGAUUCAA | 1247 | UUGAAUCUUCCUCUGACUG | 1248 |
| AGUCAGAGGAAGAUUCAAG | 1249 | CUUGAAUCUUCCUCUGACU | 1250 |
| GUCAGAGGAAGAUUCAAGA | 1251 | UCUUGAAUCUUCCUCUGAC | 1252 |
| CAGAGGAAGAUUCAAGAUA | 1253 | UAUCUUGAAUCUUCCUCUG | 1254 |
| AGAGGAAGAUUCAAGAUAC | 1255 | GUAUCUUGAAUCUUCCUCU | 1256 |
| GAGGAAGAUUCAAGAUACA | 1257 | UGUAUCUUGAAUCUUCCUC | 1258 |
| AGGAAGAUUCAAGAUACAU | 1259 | AUGUAUCUUGAAUCUUCCU | 1260 |
| GGAAGAUUCAAGAUACAUG | 1261 | CAUGUAUCUUGAAUCUUCC | 1262 |
| GAAGAUUCAAGAUACAUGA | 1263 | UCAUGUAUCUUGAAUCUUC | 1264 |
| AAAGUUUUGAGUUACCCUG | 1265 | CAGGGUAACUCAAAACUUU | 1266 |
| CAAAUUGCACUGCUGGUUC | 1267 | GAACCAGCAGUGCAAUUUG | 1268 |
| AAAUUGCACUGCUGGUUCC | 1269 | GGAACCAGCAGUGCAAUUU | 1270 |
| AAUUGCACUGCUGGUUCCA | 1271 | UGGAACCAGCAGUGCAAUU | 1272 |
| AUUGCACUGCUGGUUCCAG | 1273 | CUGGAACCAGCAGUGCAAU | 1274 |
| UUGCACUGCUGGUUCCAGA | 1275 | UCUGGAACCAGCAGUGCAA | 1276 |
| AAAUACUAUGUGGCUAUGG | 1277 | CCAUAGCCACAUAGUAUUU | 1278 |
| AAUACUAUGUGGCUAUGGA | 1279 | UCCAUAGCCACAUAGUAUU | 1280 |
| AUACUAUGUGGCUAUGGAC | 1281 | GUCCAUAGCCACAUAGUAU | 1282 |
| UACUAUGUGGCUAUGGACU | 1283 | AGUCCAUAGCCACAUAGUA | 1284 |
| ACUAUGUGGCUAUGGACUU | 1285 | AAGUCCAUAGCCACAUAGU | 1286 |
| CUAUGUGGCUAUGGACUUC | 1287 | GAAGUCCAUAGCCACAUAG | 1288 |
| UAUGUGGCUAUGGACUUCC | 1289 | GGAAGUCCAUAGCCACAUA | 1290 |
| AUGUGGCUAUGGACUUCCA | 1291 | UGGAAGUCCAUAGCCACAU | 1292 |
| UGUGGCUAUGGACUUCCAA | 1293 | UUGGAAGUCCAUAGCCACA | 1294 |
| GUGGCUAUGGACUUCCAAG | 1295 | CUUGGAAGUCCAUAGCCAC | 1296 |
| UGGCUAUGGACUUCCAAGC | 1297 | GCUUGGAAGUCCAUAGCCA | 1298 |

TABLE 4-continued

| Sense Sequence | SEQ ID NO: | Antisense Sequence | SEQ ID NO: |
|---|---|---|---|
| GCUAUGGACUUCCAAGCCA | 1299 | UGGCUUGGAAGUCCAUAGC | 1300 |
| CUAUGGACUUCCAAGCCAA | 1301 | UUGGCUUGGAAGUCCAUAG | 1302 |
| UAUGGACUUCCAAGCCAAG | 1303 | CUUGGCUUGGAAGUCCAUA | 1304 |
| CUUCCAAGCCAAGUUAGGU | 1305 | ACCUAACUUGGCUUGGAAG | 1306 |
| UUCCAAGCCAAGUUAGGUG | 1307 | CACCUAACUUGGCUUGGAA | 1308 |
| UCCAAGCCAAGUUAGGUGA | 1309 | UCACCUAACUUGGCUUGGA | 1310 |
| CCAAGCCAAGUUAGGUGAU | 1311 | AUCACCUAACUUGGCUUGG | 1312 |
| CAAGCCAAGUUAGGUGAUG | 1313 | CAUCACCUAACUUGGCUUG | 1314 |
| AAGCCAAGUUAGGUGAUGG | 1315 | CCAUCACCUAACUUGGCUU | 1316 |
| CCAAGUUAGGUGAUGGCUU | 1317 | AAGCCAUCACCUAACUUGG | 1318 |
| CAAGUUAGGUGAUGGCUUU | 1319 | AAAGCCAUCACCUAACUUG | 1320 |
| UUAGGUGAUGGCUUUGAAG | 1321 | CUUCAAAGCCAUCACCUAA | 1322 |
| GUGAUGGCUUUGAAGGGUU | 1323 | AACCCUUCAAAGCCAUCAC | 1324 |
| UGAUGGCUUUGAAGGGUUU | 1325 | AAACCCUUCAAAGCCAUCA | 1326 |
| GAUGGCUUUGAAGGGUUUU | 1327 | AAAACCCUUCAAAGCCAUC | 1328 |
| AUGGCUUUGAAGGGUUUUA | 1329 | UAAAACCCUUCAAAGCCAU | 1330 |
| UGGCUUUGAAGGGUUUUAU | 1331 | AUAAAACCCUUCAAAGCCA | 1332 |
| UGAAGGGUUUUAUAAAAGC | 1333 | GCUUUUAUAAAACCCUUCA | 1334 |
| GAAGGGUUUUAUAAAAGCA | 1335 | UGCUUUUAUAAAACCCUUC | 1336 |
| AAGGGUUUUAUAAAAGCAC | 1337 | GUGCUUUUAUAAAACCCUU | 1338 |
| AGAUUUUGAGCCAACCCAG | 1339 | CUGGGUUGGCUCAAAAUCU | 1340 |
| GAUUUUGAGCCAACCCAGG | 1341 | CCUGGGUUGGCUCAAAAUC | 1342 |
| AUUUUGAGCCAACCCAGGC | 1343 | GCCUGGGUUGGCUCAAAAU | 1344 |
| AGCCAACCCAGGCACGCAU | 1345 | AUGCGUGCCUGGGUUGGCU | 1346 |
| AACCCAGGCACGCAUGGCU | 1347 | AGCCAUGCGUGCCUGGGUU | 1348 |
| ACCCAGGCACGCAUGGCUU | 1349 | AAGCCAUGCGUGCCUGGGU | 1350 |
| CCCAGGCACGCAUGGCUUU | 1351 | AAAGCCAUGCGUGCCUGGG | 1352 |
| CCAGGCACGCAUGGCUUUC | 1353 | GAAAGCCAUGCGUGCCUGG | 1354 |
| CAGGCACGCAUGGCUUUCC | 1355 | GGAAAGCCAUGCGUGCCUG | 1356 |
| CACGCAUGGCUUUCCCUUG | 1357 | CAAGGGAAAGCCAUGCGUG | 1358 |
| CAUGGCUUUCCCUUGCUUU | 1359 | AAAGCAAGGGAAAGCCAUG | 1360 |
| GCUUUCCCUUGCUUUGAUG | 1361 | CAUCAAAGCAAGGGAAAGC | 1362 |
| CUUUCCCUUGCUUUGAUGA | 1363 | UCAUCAAAGCAAGGGAAAG | 1364 |
| UUUCCCUUGCUUUGAUGAA | 1365 | UUCAUCAAAGCAAGGGAAA | 1366 |
| AAGCCAACUUUUCAAUCAA | 1367 | UUGAUUGAAAAGUUGGCUU | 1368 |
| AGCCAACUUUUCAAUCAAG | 1369 | CUUGAUUGAAAAGUUGGCU | 1370 |
| GCCAACUUUUCAAUCAAGA | 1371 | UCUUGAUUGAAAAGUUGGC | 1372 |
| CCAACUUUUCAAUCAAGAU | 1373 | AUCUUGAUUGAAAAGUUGG | 1374 |
| ACUUUUCAAUCAAGAUACG | 1375 | CGUAUCUUGAUUGAAAAGU | 1376 |

53

54

TABLE 4-continued

| Sense Sequence | SEQ ID NO: | Antisense Sequence | SEQ ID NO: |
|---|---|---|---|
| CUUUUCAAUCAAGAUACGA | 1377 | UCGUAUCUUGAUUGAAAAG | 1378 |
| UUUCAAUCAAGAUACGAAG | 1379 | CUUCGUAUCUUGAUUGAAA | 1380 |
| UUCAAUCAAGAUACGAAGA | 1381 | UCUUCGUAUCUUGAUUGAA | 1382 |
| UCAAUCAAGAUACGAAGAG | 1383 | CUCUUCGUAUCUUGAUUGA | 1384 |
| GCAGGCAUAUUGCACUAUC | 1385 | GAUAGUGCAAUAUGCCUGC | 1386 |
| CAGGCAUAUUGCACUAUCC | 1387 | GGAUAGUGCAAUAUGCCUG | 1388 |
| CUUGAAGGAGGUCUUUUGG | 1389 | CCAAAAGACCUCCUUCAAG | 1390 |
| UUGAAGGAGGUCUUUUGGA | 1391 | UCCAAAAGACCUCCUUCAA | 1392 |
| GAAGGAGGUCUUUUGGAAG | 1393 | CUUCCAAAAGACCUCCUUC | 1394 |
| UUUGGAAGAUCACUUUGAA | 1395 | UUCAAAGUGAUCUUCCAAA | 1396 |
| AAAAUGAGUACAUACCUUG | 1397 | CAAGGUAUGUACUCAUUUU | 1398 |
| AAAUGAGUACAUACCUUGU | 1399 | ACAAGGUAUGUACUCAUUU | 1400 |
| GUAGCCUACAUAGUUUGUG | 1401 | CACAAACUAUGUAGGCUAC | 1402 |
| AUAGUUUGUGAUUUCCACU | 1403 | AGUGGAAAUCACAAACUAU | 1404 |
| UAGUUUGUGAUUUCCACUC | 1405 | GAGUGGAAAUCACAAACUA | 1406 |
| AGUUUGUGAUUUCCACUCU | 1407 | AGAGUGGAAAUCACAAACU | 1408 |
| GUUUGUGAUUUCCACUCUC | 1409 | GAGAGUGGAAAUCACAAAC | 1410 |
| UUUGUGAUUUCCACUCUCU | 1411 | AGAGAGUGGAAAUCACAAA | 1412 |
| UUGUGAUUUCCACUCUCUG | 1413 | CAGAGAGUGGAAAUCACAA | 1414 |
| UGUGAUUUCCACUCUCUGA | 1415 | UCAGAGAGUGGAAAUCACA | 1416 |
| GUGAUUUCCACUCUCUGAG | 1417 | CUCAGAGAGUGGAAAUCAC | 1418 |
| GGGUCAAGGUGUCCAUCUA | 1419 | UAGAUGGACACCUUGACCC | 1420 |
| GGUCAAGGUGUCCAUCUAU | 1421 | AUAGAUGGACACCUUGACC | 1422 |
| GUCAAGGUGUCCAUCUAUG | 1423 | CAUAGAUGGACACCUUGAC | 1424 |
| UCAAGGUGUCCAUCUAUGC | 1425 | GCAUAGAUGGACACCUUGA | 1426 |
| UGCUUUGCAGGCAUCACUG | 1427 | CAGUGAUGCCUGCAAAGCA | 1428 |
| GCUUUGCAGGCAUCACUGA | 1429 | UCAGUGAUGCCUGCAAAGC | 1430 |
| CUUUGCAGGCAUCACUGAA | 1431 | UUCAGUGAUGCCUGCAAAG | 1432 |
| UUUGCAGGCAUCACUGAAG | 1433 | CUUCAGUGAUGCCUGCAAA | 1434 |
| UUGCAGGCAUCACUGAAGC | 1435 | GCUUCAGUGAUGCCUGCAA | 1436 |
| CAGGCAUCACUGAAGCUAC | 1437 | GUAGCUUCAGUGAUGCCUG | 1438 |
| AGGCAUCACUGAAGCUACU | 1439 | AGUAGCUUCAGUGAUGCCU | 1440 |
| GGCAUCACUGAAGCUACUU | 1441 | AAGUAGCUUCAGUGAUGCC | 1442 |
| AUAUCUACUAUCCACUCUC | 1443 | GAGAGUGGAUAGUAGAUAU | 1444 |
| CUACUAUCCACUCUCCAAA | 1445 | UUUGGAGAGUGGAUAGUAG | 1446 |
| CUGGAUUUAAUUGCUAUUC | 1447 | GAAUAGCAAUUAAAUCCAG | 1448 |
| UGGAUUUAAUUGCUAUUCC | 1449 | GGAAUAGCAAUUAAAUCCA | 1450 |
| GGAUUUAAUUGCUAUUCCU | 1451 | AGGAAUAGCAAUUAAAUCC | 1452 |
| UUAAUUGCUAUUCCUGACU | 1453 | AGUCAGGAAUAGCAAUUAA | 1454 |

TABLE 4-continued

| Sense Sequence | SEQ ID NO: | Antisense Sequence | SEQ ID NO: |
|---|---|---|---|
| UAAUUGCUAUUCCUGACUU | 1455 | AAGUCAGGAAUAGCAAUUA | 1456 |
| AAUUGCUAUUCCUGACUUU | 1457 | AAAGUCAGGAAUAGCAAUU | 1458 |
| AUUGCUAUUCCUGACUUUG | 1459 | CAAAGUCAGGAAUAGCAAU | 1460 |
| UUGCUAUUCCUGACUUUGC | 1461 | GCAAAGUCAGGAAUAGCAA | 1462 |
| UGCUAUUCCUGACUUUGCA | 1463 | UGCAAAGUCAGGAAUAGCA | 1464 |
| CCUGACUUUGCACCUGGAG | 1465 | CUCCAGGUGCAAAGUCAGG | 1466 |
| CUGACUUUGCACCUGGAGC | 1467 | GCUCCAGGUGCAAAGUCAG | 1468 |
| GACUUUGCACCUGGAGCCA | 1469 | UGGCUCCAGGUGCAAAGUC | 1470 |
| UUGCACCUGGAGCCAUGGA | 1471 | UCCAUGGCUCCAGGUGCAA | 1472 |
| UGCACCUGGAGCCAUGGAA | 1473 | UUCCAUGGCUCCAGGUGCA | 1474 |
| GGGCCUCAUUACAUAUAGG | 1475 | CCUAUAUGUAAUGAGGCCC | 1476 |
| GGCCUCAUUACAUAUAGGG | 1477 | CCCUAUAUGUAAUGAGGCC | 1478 |
| GCCUCAUUACAUAUAGGGA | 1479 | UCCCUAUAUGUAAUGAGGC | 1480 |
| CCAAGACCUCUUCUGCUUC | 1481 | GAAGCAGAAGAGGUCUUGG | 1482 |
| CAAGACCUCUUCUGCUUCC | 1483 | GGAAGCAGAAGAGGUCUUG | 1484 |
| AAGACCUCUUCUGCUUCCG | 1485 | CGGAAGCAGAAGAGGUCUU | 1486 |
| AGACCUCUUCUGCUUCCGA | 1487 | UCGGAAGCAGAAGAGGUCU | 1488 |
| GACCUCUUCUGCUUCCGAU | 1489 | AUCGGAAGCAGAAGAGGUC | 1490 |
| ACCUCUUCUGCUUCCGAUA | 1491 | UAUCGGAAGCAGAAGAGGU | 1492 |
| CCUCUUCUGCUUCCGAUAA | 1493 | UUAUCGGAAGCAGAAGAGG | 1494 |
| CUCUUCUGCUUCCGAUAAA | 1495 | UUUAUCGGAAGCAGAAGAG | 1496 |
| CUGUGGGUCACCAGAGUCA | 1497 | UGACUCUGGUGACCCACAG | 1498 |
| UGUGGGUCACCAGAGUCAU | 1499 | AUGACUCUGGUGACCCACA | 1500 |
| GUGGGUCACCAGAGUCAUA | 1501 | UAUGACUCUGGUGACCCAC | 1502 |
| UGGGUCACCAGAGUCAUAG | 1503 | CUAUGACUCUGGUGACCCA | 1504 |
| UCACCAGAGUCAUAGCCCA | 1505 | UGGGCUAUGACUCUGGUGA | 1506 |
| ACCAGAGUCAUAGCCCAUG | 1507 | CAUGGGCUAUGACUCUGGU | 1508 |
| GCGCACCAGUGGUUUGGCA | 1509 | UGCCAAACCACUGGUGCGC | 1510 |
| CGCACCAGUGGUUUGGCAA | 1511 | UUGCCAAACCACUGGUGCG | 1512 |
| GCACCAGUGGUUUGGCAAC | 1513 | GUUGCCAAACCACUGGUGC | 1514 |
| GUUUGGCAACCUGGUCACA | 1515 | UGUGACCAGGUUGCCAAAC | 1516 |
| AAUGGUGGAAUGAUAUUUG | 1517 | CAAAUAUCAUUCCACCAUU | 1518 |
| AUGGUGGAAUGAUAUUUGG | 1519 | CCAAAUAUCAUUCCACCAU | 1520 |
| UGGUGGAAUGAUAUUUGGC | 1521 | GCCAAAUAUCAUUCCACCA | 1522 |
| GGUGGAAUGAUAUUUGGCU | 1523 | AGCCAAAUAUCAUUCCACC | 1524 |
| GUGGAAUGAUAUUUGGCUU | 1525 | AAGCCAAAUAUCAUUCCAC | 1526 |
| UGGAAUGAUAUUUGGCUUA | 1527 | UAAGCCAAAUAUCAUUCCA | 1528 |
| GGAAUGAUAUUUGGCUUAA | 1529 | UUAAGCCAAAUAUCAUUCC | 1530 |
| GAGGGUUUUGCAAAAUACA | 1531 | UGUAUUUUGCAAAACCCUC | 1532 |

TABLE 4-continued

| Sense Sequence | SEQ ID NO: | Antisense Sequence | SEQ ID NO: |
|---|---|---|---|
| AGGGUUUUGCAAAAUACAU | 1533 | AUGUAUUUUGCAAAACCCU | 1534 |
| GGGUUUUGCAAAAUACAUG | 1535 | CAUGUAUUUUGCAAAACCC | 1536 |
| GGUUUUGCAAAAUACAUGG | 1537 | CCAUGUAUUUUGCAAAACC | 1538 |
| GUUUUGCAAAAUACAUGGA | 1539 | UCCAUGUAUUUUGCAAAAC | 1540 |
| AACUUAUCGCUGUUAAUGC | 1541 | GCAUUAACAGCGAUAAGUU | 1542 |
| ACUUAUCGCUGUUAAUGCU | 1543 | AGCAUUAACAGCGAUAAGU | 1544 |
| CUUAUCGCUGUUAAUGCUA | 1545 | UAGCAUUAACAGCGAUAAG | 1546 |
| UUAUCGCUGUUAAUGCUAC | 1547 | GUAGCAUUAACAGCGAUAA | 1548 |
| UAUCGCUGUUAAUGCUACA | 1549 | UGUAGCAUUAACAGCGAUA | 1550 |
| UUGAAUGUGUGUUUUGAAG | 1551 | CUUCAAAACACACAUUCAA | 1552 |
| UGAAUGUGUGUUUUGAAGU | 1553 | ACUUCAAAACACACAUUCA | 1554 |
| GAAUGUGUGUUUUGAAGUA | 1555 | UACUUCAAAACACACAUUC | 1556 |
| UUCAUUGAAUUCAUCCCGC | 1557 | GCGGGAUGAAUUCAAUGAA | 1558 |
| AAUGUUUGAUGAAGUUUCC | 1559 | GGAAACUUCAUCAAACAUU | 1560 |
| AAGGGAGCUUGUAUUUUGA | 1561 | UCAAAAUACAAGCUCCCUU | 1562 |
| GGGAGCUUGUAUUUUGAAU | 1563 | AUUCAAAAUACAAGCUCCC | 1564 |
| GAAUAUGCUCAAGGAUUUU | 1565 | AAAAUCCUUGAGCAUAUUC | 1566 |
| AAUAUGCUCAAGGAUUUUC | 1567 | GAAAAUCCUUGAGCAUAUU | 1568 |
| AUAUGCUCAAGGAUUUUCU | 1569 | AGAAAAUCCUUGAGCAUAU | 1570 |
| UAUGCUCAAGGAUUUUCUG | 1571 | CAGAAAAUCCUUGAGCAUA | 1572 |
| AUGCUCAAGGAUUUUCUGG | 1573 | CCAGAAAAUCCUUGAGCAU | 1574 |
| GCUCAAGGAUUUUCUGGGU | 1575 | ACCCAGAAAAUCCUUGAGC | 1576 |
| CUCAAGGAUUUUCUGGGUG | 1577 | CACCCAGAAAAUCCUUGAG | 1578 |
| UCAAGGAUUUUCUGGGUGA | 1579 | UCACCCAGAAAAUCCUUGA | 1580 |
| CAAGGAUUUUCUGGGUGAG | 1581 | CUCACCCAGAAAAUCCUUG | 1582 |
| AAGGAUUUUCUGGGUGAGG | 1583 | CCUCACCCAGAAAAUCCUU | 1584 |
| AGGAUUUUCUGGGUGAGGA | 1585 | UCCUCACCCAGAAAAUCCU | 1586 |
| GGAUUUUCUGGGUGAGGAG | 1587 | CUCCUCACCCAGAAAAUCC | 1588 |
| UAAAGAAGUUCAGCUAUAG | 1589 | CUAUAGCUGAACUUCUUUA | 1590 |
| AAAGAAGUUCAGCUAUAGA | 1591 | UCUAUAGCUGAACUUCUUU | 1592 |
| AAGAAGUUCAGCUAUAGAA | 1593 | UUCUAUAGCUGAACUUCUU | 1594 |
| AAAUGCUAAGAAUGAUGAC | 1595 | GUCAUCAUUCUUAGCAUUU | 1596 |
| AAUGCUAAGAAUGAUGACU | 1597 | AGUCAUCAUUCUUAGCAUU | 1598 |
| AAGAAUGAUGACUUGUGGA | 1599 | UCCACAAGUCAUCAUUCUU | 1600 |
| AGAAUGAUGACUUGUGGAG | 1601 | CUCCACAAGUCAUCAUUCU | 1602 |
| AAUGAUGACUUGUGGAGCA | 1603 | UGCUCCACAAGUCAUCAUU | 1604 |
| AUGAUGACUUGUGGAGCAG | 1605 | CUGCUCCACAAGUCAUCAU | 1606 |
| UGAUGACUUGUGGAGCAGU | 1607 | ACUGCUCCACAAGUCAUCA | 1608 |
| ACUUGUGGAGCAGUCUGUC | 1609 | GACAGACUGCUCCACAAGU | 1610 |

TABLE 4-continued

| Sense Sequence | SEQ ID NO: | Antisense Sequence | SEQ ID NO: |
|---|---|---|---|
| CUUGUGGAGCAGUCUGUCA | 1611 | UGACAGACUGCUCCACAAG | 1612 |
| UUGUGGAGCAGUCUGUCAA | 1613 | UUGACAGACUGCUCCACAA | 1614 |
| UGUGGAGCAGUCUGUCAAA | 1615 | UUUGACAGACUGCUCCACA | 1616 |
| GUGGAGCAGUCUGUCAAAU | 1617 | AUUUGACAGACUGCUCCAC | 1618 |
| UGGAGCAGUCUGUCAAAUA | 1619 | UAUUUGACAGACUGCUCCA | 1620 |
| GCAGUCUGUCAAAUAGUUG | 1621 | CAACUAUUUGACAGACUGC | 1622 |
| CAGUCUGUCAAAUAGUUGU | 1623 | ACAACUAUUUGACAGACUG | 1624 |
| AGUCUGUCAAAUAGUUGUU | 1625 | AACAACUAUUUGACAGACU | 1626 |
| GUCUGUCAAAUAGUUGUUU | 1627 | AAACAACUAUUUGACAGAC | 1628 |
| CUGUCAAAUAGUUGUUUAG | 1629 | CUAAACAACUAUUUGACAG | 1630 |
| GUGAUUUUACAUCUGGUGG | 1631 | CCACCAGAUGUAAAAUCAC | 1632 |
| UGAUUUUACAUCUGGUGGA | 1633 | UCCACCAGAUGUAAAAUCA | 1634 |
| GAUUUUACAUCUGGUGGAG | 1635 | CUCCACCAGAUGUAAAAUC | 1636 |
| UACAUCUGGUGGAGUUUGU | 1637 | ACAAACUCCACCAGAUGUA | 1638 |
| ACAUCUGGUGGAGUUUGUC | 1639 | GACAAACUCCACCAGAUGU | 1640 |
| CAUCUGGUGGAGUUUGUCA | 1641 | UGACAAACUCCACCAGAUG | 1642 |
| UGGUGGAGUUUGUCAUUCG | 1643 | CGAAUGACAAACUCCACCA | 1644 |
| GGUGGAGUUUGUCAUUCGG | 1645 | CCGAAUGACAAACUCCACC | 1646 |
| GUGGAGUUUGUCAUUCGGA | 1647 | UCCGAAUGACAAACUCCAC | 1648 |
| UGGAGUUUGUCAUUCGGAU | 1649 | AUCCGAAUGACAAACUCCA | 1650 |
| GGAGUUUGUCAUUCGGAUC | 1651 | GAUCCGAAUGACAAACUCC | 1652 |
| GAGUUUGUCAUUCGGAUCC | 1653 | GGAUCCGAAUGACAAACUC | 1654 |
| AGUUUGUCAUUCGGAUCCC | 1655 | GGGAUCCGAAUGACAAACU | 1656 |
| UGUCAUUCGGAUCCCAAGA | 1657 | UCUUGGGAUCCGAAUGACA | 1658 |
| GUCAUUCGGAUCCCAAGAU | 1659 | AUCUUGGGAUCCGAAUGAC | 1660 |
| UCAUUCGGAUCCCAAGAUG | 1661 | CAUCUUGGGAUCCGAAUGA | 1662 |
| CAUUCGGAUCCCAAGAUGA | 1663 | UCAUCUUGGGAUCCGAAUG | 1664 |
| AUUCGGAUCCCAAGAUGAC | 1665 | GUCAUCUUGGGAUCCGAAU | 1666 |
| UUCGGAUCCCAAGAUGACA | 1667 | UGUCAUCUUGGGAUCCGAA | 1668 |
| ACAUGCUCGCCUUUCUGGG | 1669 | CCCAGAAAGGCGAGCAUGU | 1670 |
| AAAAUGCAGAGGUCAAAGA | 1671 | UCUUUGACCUCUGCAUUUU | 1672 |
| AGAUGAUGACUACAUGGAC | 1673 | GUCCAUGUAGUCAUCAUCU | 1674 |
| AUGAUGACUACAUGGACUC | 1675 | GAGUCCAUGUAGUCAUCAU | 1676 |
| UGAUGACUACAUGGACUCU | 1677 | AGAGUCCAUGUAGUCAUCA | 1678 |
| GAUGACUACAUGGACUCUC | 1679 | GAGAGUCCAUGUAGUCAUC | 1680 |
| GACGGGUGUUCACUCCGAC | 1681 | GUCGGAGUGAACACCCGUC | 1682 |
| ACGGGUGUUCACUCCGACU | 1683 | AGUCGGAGUGAACACCCGU | 1684 |
| CGGGUGUUCACUCCGACUG | 1685 | CAGUCGGAGUGAACACCCG | 1686 |
| GGGUGUUCACUCCGACUGC | 1687 | GCAGUCGGAGUGAACACCC | 1688 |

TABLE 4-continued

| Sense Sequence | SEQ ID NO: | Antisense Sequence | SEQ ID NO: |
|---|---|---|---|
| GGUGUUCACUCCGACUGCA | 1689 | UGCAGUCGGAGUGAACACC | 1690 |
| GUGUUCACUCCGACUGCAA | 1691 | UUGCAGUCGGAGUGAACAC | 1692 |
| UGUUCACUCCGACUGCAAC | 1693 | GUUGCAGUCGGAGUGAACA | 1694 |
| AGAGGUACCUGUGGCAUAU | 1695 | AUAUGCCACAGGUACCUCU | 1696 |
| CCUGUGGCAUAUCCCAUUG | 1697 | CAAUGGGAUAUGCCACAGG | 1698 |
| CUGUGGCAUAUCCCAUUGA | 1699 | UCAAUGGGAUAUGCCACAG | 1700 |
| CAUAUCCCAUUGACCUACU | 1701 | AGUAGGUCAAUGGGAUAUG | 1702 |
| AUAUCCCAUUGACCUACUC | 1703 | GAGUAGGUCAAUGGGAUAU | 1704 |
| UAUCCCAUUGACCUACUCC | 1705 | GGAGUAGGUCAAUGGGAUA | 1706 |
| CCAUUGACCUACUCCACGA | 1707 | UCGUGGAGUAGGUCAAUGG | 1708 |
| CAUUGACCUACUCCACGAG | 1709 | CUCGUGGAGUAGGUCAAUG | 1710 |
| CUCCACGAGUUCUUCUAAU | 1711 | AUUAGAAGAACUCGUGGAG | 1712 |
| UCCACGAGUUCUUCUAAUG | 1713 | CAUUAGAAGAACUCGUGGA | 1714 |
| AGUUCUUCUAAUGUGAUCC | 1715 | GGAUCACAUUAGAAGAACU | 1716 |
| GUUCUUCUAAUGUGAUCCA | 1717 | UGGAUCACAUUAGAAGAAC | 1718 |
| UUCUUCUAAUGUGAUCCAC | 1719 | GUGGAUCACAUUAGAAGAA | 1720 |
| AAAAGACCAGUUGGGUGAA | 1721 | UUCACCCAACUGGUCUUUU | 1722 |
| UUUAAUGUGGACUCAAAUG | 1723 | CAUUUGAGUCCACAUUAAA | 1724 |
| UUAAUGUGGACUCAAAUGG | 1725 | CCAUUUGAGUCCACAUUAA | 1726 |
| UAAUGUGGACUCAAAUGGU | 1727 | ACCAUUUGAGUCCACAUUA | 1728 |
| AAUGUGGACUCAAAUGGUU | 1729 | AACCAUUUGAGUCCACAUU | 1730 |
| AUGUGGACUCAAAUGGUUA | 1731 | UAACCAUUUGAGUCCACAU | 1732 |
| UGUGGACUCAAAUGGUUAC | 1733 | GUAACCAUUUGAGUCCACA | 1734 |
| GUGGACUCAAAUGGUUACU | 1735 | AGUAACCAUUUGAGUCCAC | 1736 |
| UGGACUCAAAUGGUUACUA | 1737 | UAGUAACCAUUUGAGUCCA | 1738 |
| GGACUCAAAUGGUUACUAC | 1739 | GUAGUAACCAUUUGAGUCC | 1740 |
| GACUCAAAUGGUUACUACA | 1741 | UGUAGUAACCAUUUGAGUC | 1742 |
| CAAAUGGUUACUACAUCGU | 1743 | ACGAUGUAGUAACCAUUUG | 1744 |
| AAUGGUUACUACAUCGUUC | 1745 | GAACGAUGUAGUAACCAUU | 1746 |
| AUGGUUACUACAUCGUUCA | 1747 | UGAACGAUGUAGUAACCAU | 1748 |
| UGGUUACUACAUCGUUCAC | 1749 | GUGAACGAUGUAGUAACCA | 1750 |
| GGUUACUACAUCGUUCACU | 1751 | AGUGAACGAUGUAGUAACC | 1752 |
| GUUACUACAUCGUUCACUA | 1753 | UAGUGAACGAUGUAGUAAC | 1754 |
| UUACUACAUCGUUCACUAU | 1755 | AUAGUGAACGAUGUAGUAA | 1756 |
| UACUACAUCGUUCACUAUG | 1757 | CAUAGUGAACGAUGUAGUA | 1758 |
| ACAUCGUUCACUAUGAGGG | 1759 | CCCUCAUAGUGAACGAUGU | 1760 |
| CAUCGUUCACUAUGAGGGU | 1761 | ACCCUCAUAGUGAACGAUG | 1762 |
| UGAGGGUCAUGGAUGGGAC | 1763 | GUCCCAUCCAUGACCCUCA | 1764 |
| CACACUUCUCAGACCUAAG | 1765 | CUUAGGUCUGAGAAGUGUG | 1766 |

TABLE 4-continued

| Sense Sequence | SEQ ID NO: | Antisense Sequence | SEQ ID NO: |
|---|---|---|---|
| ACACUUCUCAGACCUAAGG | 1767 | CCUUAGGUCUGAGAAGUGU | 1768 |
| CACUUCUCAGACCUAAGGA | 1769 | UCCUUAGGUCUGAGAAGUG | 1770 |
| ACUUCUCAGACCUAAGGAC | 1771 | GUCCUUAGGUCUGAGAAGU | 1772 |
| UUCUCAGACCUAAGGACAG | 1773 | CUGUCCUUAGGUCUGAGAA | 1774 |
| UCUCAGACCUAAGGACAGA | 1775 | UCUGUCCUUAGGUCUGAGA | 1776 |
| CUCAGACCUAAGGACAGAG | 1777 | CUCUGUCCUUAGGUCUGAG | 1778 |
| UCAGACCUAAGGACAGAGU | 1779 | ACUCUGUCCUUAGGUCUGA | 1780 |
| CAGACCUAAGGACAGAGUA | 1781 | UACUCUGUCCUUAGGUCUG | 1782 |
| AGACCUAAGGACAGAGUAG | 1783 | CUACUCUGUCCUUAGGUCU | 1784 |
| UCUGAUUCAUGAUGUGUUU | 1785 | AAACACAUCAUGAAUCAGA | 1786 |
| AUUCAUGAUGUGUUUCAGC | 1787 | GCUGAAACACAUCAUGAAU | 1788 |
| CAAAGCUCUUGACAUGACU | 1789 | AGUCAUGUCAAGAGCUUUG | 1790 |
| AAAGCUCUUGACAUGACUU | 1791 | AAGUCAUGUCAAGAGCUUU | 1792 |
| AAGCUCUUGACAUGACUUA | 1793 | UAAGUCAUGUCAAGAGCUU | 1794 |
| AGCUCUUGACAUGACUUAC | 1795 | GUAAGUCAUGUCAAGAGCU | 1796 |
| GCUCUUGACAUGACUUACU | 1797 | AGUAAGUCAUGUCAAGAGC | 1798 |
| CUCUUGACAUGACUUACUA | 1799 | UAGUAAGUCAUGUCAAGAG | 1800 |
| UCUUGACAUGACUUACUAC | 1801 | GUAGUAAGUCAUGUCAAGA | 1802 |
| CUUGACAUGACUUACUACC | 1803 | GGUAGUAAGUCAUGUCAAG | 1804 |
| CCCGCACUUCUCGAAGGUC | 1805 | GACCUUCGAGAAGUGCGGG | 1806 |
| CCGCACUUCUCGAAGGUCU | 1807 | AGACCUUCGAGAAGUGCGG | 1808 |
| GCACUUCUCGAAGGUCUGA | 1809 | UCAGACCUUCGAGAAGUGC | 1810 |
| CACUUCUCGAAGGUCUGAG | 1811 | CUCAGACCUUCGAGAAGUG | 1812 |
| UCUCGAAGGUCUGAGUUAC | 1813 | GUAACUCAGACCUUCGAGA | 1814 |
| CUCGAAGGUCUGAGUUACU | 1815 | AGUAACUCAGACCUUCGAG | 1816 |
| UCGAAGGUCUGAGUUACUU | 1817 | AAGUAACUCAGACCUUCGA | 1818 |
| CGAAGGUCUGAGUUACUUG | 1819 | CAAGUAACUCAGACCUUCG | 1820 |
| AAGGUCUGAGUUACUUGGA | 1821 | UCCAAGUAACUCAGACCUU | 1822 |
| AGGUCUGAGUUACUUGGAA | 1823 | UUCCAAGUAACUCAGACCU | 1824 |
| GGUCUGAGUUACUUGGAAU | 1825 | AUUCCAAGUAACUCAGACC | 1826 |
| GUCUGAGUUACUUGGAAUC | 1827 | GAUUCCAAGUAACUCAGAC | 1828 |
| UCUGAGUUACUUGGAAUCG | 1829 | CGAUUCCAAGUAACUCAGA | 1830 |
| CUGAGUUACUUGGAAUCGU | 1831 | ACGAUUCCAAGUAACUCAG | 1832 |
| UGAGUUACUUGGAAUCGUU | 1833 | AACGAUUCCAAGUAACUCA | 1834 |
| GAGUUACUUGGAAUCGUUU | 1835 | AAACGAUUCCAAGUAACUC | 1836 |
| AGUUACUUGGAAUCGUUUU | 1837 | AAAACGAUUCCAAGUAACU | 1838 |
| GUUACUUGGAAUCGUUUUA | 1839 | UAAAACGAUUCCAAGUAAC | 1840 |
| UUACUUGGAAUCGUUUUAC | 1841 | GUAAAACGAUUCCAAGUAA | 1842 |
| UACUUGGAAUCGUUUUACC | 1843 | GGUAAAACGAUUCCAAGUA | 1844 |

TABLE 4-continued

| Sense Sequence | SEQ ID NO: | Antisense Sequence | SEQ ID NO: |
|---|---|---|---|
| ACUUGGAAUCGUUUUACCA | 1845 | UGGUAAAACGAUUCCAAGU | 1846 |
| CUUGGAAUCGUUUUACCAC | 1847 | GUGGUAAAACGAUUCCAAG | 1848 |
| UUGGAAUCGUUUUACCACA | 1849 | UGUGGUAAAACGAUUCCAA | 1850 |
| AAUCGUUUUACCACAUGAU | 1851 | AUCAUGUGGUAAAACGAUU | 1852 |
| AUCGUUUUACCACAUGAUG | 1853 | CAUCAUGUGGUAAAACGAU | 1854 |
| UCGUUUUACCACAUGAUGG | 1855 | CCAUCAUGUGGUAAAACGA | 1856 |
| CGUUUUACCACAUGAUGGA | 1857 | UCCAUCAUGUGGUAAAACG | 1858 |
| GUUUUACCACAUGAUGGAC | 1859 | GUCCAUCAUGUGGUAAAAC | 1860 |
| UUUACCACAUGAUGGACAG | 1861 | CUGUCCAUCAUGUGGUAAA | 1862 |
| UUACCACAUGAUGGACAGA | 1863 | UCUGUCCAUCAUGUGGUAA | 1864 |
| UACCACAUGAUGGACAGAA | 1865 | UUCUGUCCAUCAUGUGGUA | 1866 |
| ACCACAUGAUGGACAGAAG | 1867 | CUUCUGUCCAUCAUGUGGU | 1868 |
| CAUGAUGGACAGAAGGAAU | 1869 | AUUCCUUCUGUCCAUCAUG | 1870 |
| UGAUGGACAGAAGGAAUAU | 1871 | AUAUUCCUUCUGUCCAUCA | 1872 |
| GAUGGACAGAAGGAAUAUU | 1873 | AAUAUUCCUUCUGUCCAUC | 1874 |
| AUGGACAGAAGGAAUAUUU | 1875 | AAAUAUUCCUUCUGUCCAU | 1876 |
| UGGACAGAAGGAAUAUUUC | 1877 | GAAAUAUUCCUUCUGUCCA | 1878 |
| CAGAAGGAAUAUUUCAGAU | 1879 | AUCUGAAAUAUUCCUUCUG | 1880 |
| CUCAAGCGUUACCUUCUUC | 1881 | GAAGAAGGUAACGCUUGAG | 1882 |
| AGCGUUACCUUCUUCAGUA | 1883 | UACUGAAGAAGGUAACGCU | 1884 |
| GCGUUACCUUCUUCAGUAU | 1885 | AUACUGAAGAAGGUAACGC | 1886 |
| CCUUCUUCAGUAUUUUAAG | 1887 | CUUAAAAUACUGAAGAAGG | 1888 |
| UUCUUCAGUAUUUUAAGCC | 1889 | GGCUUAAAAUACUGAAGAA | 1890 |
| UCUUCAGUAUUUUAAGCCA | 1891 | UGGCUUAAAAUACUGAAGA | 1892 |
| AUUUUAAGCCAGUGAUUGA | 1893 | UCAAUCACUGGCUUAAAAU | 1894 |
| UUUUAAGCCAGUGAUUGAC | 1895 | GUCAAUCACUGGCUUAAAA | 1896 |
| UUUAAGCCAGUGAUUGACA | 1897 | UGUCAAUCACUGGCUUAAA | 1898 |
| UUAAGCCAGUGAUUGACAG | 1899 | CUGUCAAUCACUGGCUUAA | 1900 |
| UAAGCCAGUGAUUGACAGG | 1901 | CCUGUCAAUCACUGGCUUA | 1902 |
| AAGCCAGUGAUUGACAGGC | 1903 | GCCUGUCAAUCACUGGCUU | 1904 |
| CAGUGAUUGACAGGCAAAG | 1905 | CUUUGCCUGUCAAUCACUG | 1906 |
| AGUGAUUGACAGGCAAAGC | 1907 | GCUUUGCCUGUCAAUCACU | 1908 |
| AUUGACAGGCAAAGCUGGA | 1909 | UCCAGCUUUGCCUGUCAAU | 1910 |
| UUGACAGGCAAAGCUGGAG | 1911 | CUCCAGCUUUGCCUGUCAA | 1912 |
| GCUCGGCUCUCUUGAAGCU | 1913 | AGCUUCAAGAGAGCCGAGC | 1914 |
| UCGGCUCUCUUGAAGCUGG | 1915 | CCAGCUUCAAGAGAGCCGA | 1916 |
| CGGCUCUCUUGAAGCUGGC | 1917 | GCCAGCUUCAAGAGAGCCG | 1918 |
| GGCUCUCUUGAAGCUGGCC | 1919 | GGCCAGCUUCAAGAGAGCC | 1920 |
| GCUCUCUUGAAGCUGGCCU | 1921 | AGGCCAGCUUCAAGAGAGC | 1922 |

TABLE 4-continued

| Sense Sequence | SEQ ID NO: | Antisense Sequence | SEQ ID NO: |
|---|---|---|---|
| CUCUCUUGAAGCUGGCCUG | 1923 | CAGGCCAGCUUCAAGAGAG | 1924 |
| UCUCUUGAAGCUGGCCUGU | 1925 | ACAGGCCAGCUUCAAGAGA | 1926 |
| AGCUGGCCUGUGACCUGAA | 1927 | UUCAGGUCACAGGCCAGCU | 1928 |
| AGAUUGUGUAUUCUGUGGG | 1929 | CCCACAGAAUACACAAUCU | 1930 |
| CAGCAGGAUGGAAUUACCU | 1931 | AGGUAAUUCCAUCCUGCUG | 1932 |
| CAGGAUGGAAUUACCUUUU | 1933 | AAAAGGUAAUUCCAUCCUG | 1934 |
| AGGAUGGAAUUACCUUUUA | 1935 | UAAAAGGUAAUUCCAUCCU | 1936 |
| GGAUGGAAUUACCUUUUAG | 1937 | CUAAAAGGUAAUUCCAUCC | 1938 |
| GAUGGAAUUACCUUUUAGA | 1939 | UCUAAAAGGUAAUUCCAUC | 1940 |
| AUGGAAUUACCUUUUAGAG | 1941 | CUCUAAAAGGUAAUUCCAU | 1942 |
| GGAAUUACCUUUUAGAGCA | 1943 | UGCUCUAAAAGGUAAUUCC | 1944 |
| GAAUUACCUUUUAGAGCAA | 1945 | UUGCUCUAAAAGGUAAUUC | 1946 |
| ACCUUUUAGAGCAAUAUGA | 1947 | UCAUAUUGCUCUAAAAGGU | 1948 |
| CCUUUUAGAGCAAUAUGAA | 1949 | UUCAUAUUGCUCUAAAAGG | 1950 |
| AACUGUCAAUGUCAAGUGC | 1951 | GCACUUGACAUUGACAGUU | 1952 |
| ACUGUCAAUGUCAAGUGCU | 1953 | AGCACUUGACAUUGACAGU | 1954 |
| AAUUCUGUAUGCUUUGUCA | 1955 | UGACAAAGCAUACAGAAUU | 1956 |
| CUGUAUGCUUUGUCAACGA | 1957 | UCGUUGACAAAGCAUACAG | 1958 |
| UGUAUGCUUUGUCAACGAG | 1959 | CUCGUUGACAAAGCAUACA | 1960 |
| GUAUGCUUUGUCAACGAGC | 1961 | GCUCGUUGACAAAGCAUAC | 1962 |
| CUUUGUCAACGAGCAAGCA | 1963 | UGCUUGCUCGUUGACAAAG | 1964 |
| UUUGUCAACGAGCAAGCAU | 1965 | AUGCUUGCUCGUUGACAAA | 1966 |
| UUGUCAACGAGCAAGCAUC | 1967 | GAUGCUUGCUCGUUGACAA | 1968 |
| UGUCAACGAGCAAGCAUCA | 1969 | UGAUGCUUGCUCGUUGACA | 1970 |
| AACUUGGCAGCUCUCCUUC | 1971 | GAAGGAGAGCUGCCAAGUU | 1972 |
| CUUGGCAGCUCUCCUUCAU | 1973 | AUGAAGGAGAGCUGCCAAG | 1974 |
| UUGGCAGCUCUCCUUCAUG | 1975 | CAUGAAGGAGAGCUGCCAA | 1976 |
| UGGCAGCUCUCCUUCAUGC | 1977 | GCAUGAAGGAGAGCUGCCA | 1978 |
| GGCAGCUCUCCUUCAUGCG | 1979 | CGCAUGAAGGAGAGCUGCC | 1980 |
| GCAGCUCUCCUUCAUGCGA | 1981 | UCGCAUGAAGGAGAGCUGC | 1982 |
| CAGCUCUCCUUCAUGCGAU | 1983 | AUCGCAUGAAGGAGAGCUG | 1984 |
| AGCUCUCCUUCAUGCGAUU | 1985 | AAUCGCAUGAAGGAGAGCU | 1986 |
| GCUCUCCUUCAUGCGAUUG | 1987 | CAAUCGCAUGAAGGAGAGC | 1988 |
| CUCUCCUUCAUGCGAUUGC | 1989 | GCAAUCGCAUGAAGGAGAG | 1990 |
| UCUCCUUCAUGCGAUUGCC | 1991 | GGCAAUCGCAUGAAGGAGA | 1992 |
| CUCCUUCAUGCGAUUGCCA | 1993 | UGGCAAUCGCAUGAAGGAG | 1994 |
| UCCUUCAUGCGAUUGCCAG | 1995 | CUGGCAAUCGCAUGAAGGA | 1996 |
| CCUUCAUGCGAUUGCCAGA | 1997 | UCUGGCAAUCGCAUGAAGG | 1998 |
| CUUCAUGCGAUUGCCAGAC | 1999 | GUCUGGCAAUCGCAUGAAG | 2000 |

TABLE 4-continued

| Sense Sequence | SEQ ID NO: | Antisense Sequence | SEQ ID NO: |
|---|---|---|---|
| UUCAUGCGAUUGCCAGACG | 2001 | CGUCUGGCAAUCGCAUGAA | 2002 |
| UCAUGCGAUUGCCAGACGU | 2003 | ACGUCUGGCAAUCGCAUGA | 2004 |
| CAUGCGAUUGCCAGACGUC | 2005 | GACGUCUGGCAAUCGCAUG | 2006 |
| AUGCGAUUGCCAGACGUCC | 2007 | GGACGUCUGGCAAUCGCAU | 2008 |
| UGCGAUUGCCAGACGUCCA | 2009 | UGGACGUCUGGCAAUCGCA | 2010 |
| GCGAUUGCCAGACGUCCAA | 2011 | UUGGACGUCUGGCAAUCGC | 2012 |
| CGAUUGCCAGACGUCCAAA | 2013 | UUUGGACGUCUGGCAAUCG | 2014 |
| UAGCAUGGGAUUUUGUAAG | 2015 | CUUACAAAAUCCCAUGCUA | 2016 |
| GCAUGGGAUUUUGUAAGAG | 2017 | CUCUUACAAAAUCCCAUGC | 2018 |
| AAAAUUGGACCCAUCUUCU | 2019 | AGAAGAUGGGUCCAAUUUU | 2020 |
| AAAUUGGACCCAUCUUCUG | 2021 | CAGAAGAUGGGUCCAAUUU | 2022 |
| AAUUGGACCCAUCUUCUGA | 2023 | UCAGAAGAUGGGUCCAAUU | 2024 |
| AUUGGACCCAUCUUCUGAA | 2025 | UUCAGAAGAUGGGUCCAAU | 2026 |
| AAAAUUUGACUUGGGCUCA | 2027 | UGAGCCCAAGUCAAAUUUU | 2028 |
| AAAUUUGACUUGGGCUCAU | 2029 | AUGAGCCCAAGUCAAAUUU | 2030 |
| AAUUUGACUUGGGCUCAUA | 2031 | UAUGAGCCCAAGUCAAAUU | 2032 |
| AUUUGACUUGGGCUCAUAU | 2033 | AUAUGAGCCCAAGUCAAAU | 2034 |
| UUUGACUUGGGCUCAUAUG | 2035 | CAUAUGAGCCCAAGUCAAA | 2036 |
| UUGACUUGGGCUCAUAUGA | 2037 | UCAUAUGAGCCCAAGUCAA | 2038 |
| UGACUUGGGCUCAUAUGAC | 2039 | GUCAUAUGAGCCCAAGUCA | 2040 |
| GACUUGGGCUCAUAUGACA | 2041 | UGUCAUAUGAGCCCAAGUC | 2042 |
| ACUUGGGCUCAUAUGACAU | 2043 | AUGUCAUAUGAGCCCAAGU | 2044 |
| UUGGGCUCAUAUGACAUAA | 2045 | UUAUGUCAUAUGAGCCCAA | 2046 |
| UGGGCUCAUAUGACAUAAG | 2047 | CUUAUGUCAUAUGAGCCCA | 2048 |
| GGGCUCAUAUGACAUAAGG | 2049 | CCUUAUGUCAUAUGAGCCC | 2050 |
| GGCUCAUAUGACAUAAGGA | 2051 | UCCUUAUGUCAUAUGAGCC | 2052 |
| CAUAUGACAUAAGGAUGAU | 2053 | AUCAUCCUUAUGUCAUAUG | 2054 |
| AUAUGACAUAAGGAUGAUC | 2055 | GAUCAUCCUUAUGUCAUAU | 2056 |
| UAUGACAUAAGGAUGAUCA | 2057 | UGAUCAUCCUUAUGUCAUA | 2058 |
| AGCUCACUUUUCUUCCAAG | 2059 | CUUGGAAGAAAAGUGAGCU | 2060 |
| CUUUUCUUCCAAGGAUAAG | 2061 | CUUAUCCUUGGAAGAAAAG | 2062 |
| UUUCUUCCAAGGAUAAGUU | 2063 | AACUUAUCCUUGGAAGAAA | 2064 |
| UUCUUCCAAGGAUAAGUUG | 2065 | CAACUUAUCCUUGGAAGAA | 2066 |
| UCUUCCAAGGAUAAGUUGC | 2067 | GCAACUUAUCCUUGGAAGA | 2068 |
| CUUCCAAGGAUAAGUUGCA | 2069 | UGCAACUUAUCCUUGGAAG | 2070 |
| UUCCAAGGAUAAGUUGCAA | 2071 | UUGCAACUUAUCCUUGGAA | 2072 |
| UCCAAGGAUAAGUUGCAAG | 2073 | CUUGCAACUUAUCCUUGGA | 2074 |
| CCAAGGAUAAGUUGCAAGA | 2075 | UCUUGCAACUUAUCCUUGG | 2076 |
| CAAGGAUAAGUUGCAAGAG | 2077 | CUCUUGCAACUUAUCCUUG | 2078 |

TABLE 4-continued

| Sense Sequence | SEQ ID NO: | Antisense Sequence | SEQ ID NO: |
|---|---|---|---|
| AAGGAUAAGUUGCAAGAGG | 2079 | CCUCUUGCAACUUAUCCUU | 2080 |
| AGGAUAAGUUGCAAGAGGU | 2081 | ACCUCUUGCAACUUAUCCU | 2082 |
| GGAUAAGUUGCAAGAGGUG | 2083 | CACCUCUUGCAACUUAUCC | 2084 |
| GAUAAGUUGCAAGAGGUGA | 2085 | UCACCUCUUGCAACUUAUC | 2086 |
| AUAAGUUGCAAGAGGUGAA | 2087 | UUCACCUCUUGCAACUUAU | 2088 |
| UUUUGAAUCUCUUGAGGCU | 2089 | AGCCUCAAGAGAUUCAAAA | 2090 |
| UUUGAAUCUCUUGAGGCUC | 2091 | GAGCCUCAAGAGAUUCAAA | 2092 |
| UUGAAUCUCUUGAGGCUCA | 2093 | UGAGCCUCAAGAGAUUCAA | 2094 |
| GAGGCUCAAGGAUCACAUC | 2095 | GAUGUGAUCCUUGAGCCUC | 2096 |
| AGGCUCAAGGAUCACAUCU | 2097 | AGAUGUGAUCCUUGAGCCU | 2098 |
| GGCUCAAGGAUCACAUCUG | 2099 | CAGAUGUGAUCCUUGAGCC | 2100 |
| AGGAUCACAUCUGGAUAUU | 2101 | AAUAUCCAGAUGUGAUCCU | 2102 |
| GAUCACAUCUGGAUAUUUU | 2103 | AAAAUAUCCAGAUGUGAUC | 2104 |
| AAAUAUAAAAUGGCUGGAG | 2105 | CUCCAGCCAUUUUAUAUUU | 2106 |
| GAGGACUUGGCUAAUGGUU | 2107 | AACCAUUAGCCAAGUCCUC | 2108 |
| AGGACUUGGCUAAUGGUUA | 2109 | UAACCAUUAGCCAAGUCCU | 2110 |
| GGACUUGGCUAAUGGUUAA | 2111 | UUAACCAUUAGCCAAGUCC | 2112 |
| GACUUGGCUAAUGGUUAAU | 2113 | AUUAACCAUUAGCCAAGUC | 2114 |
| ACUUGGCUAAUGGUUAAUA | 2115 | UAUUAACCAUUAGCCAAGU | 2116 |
| CUUGGCUAAUGGUUAAUAC | 2117 | GUAUUAACCAUUAGCCAAG | 2118 |
| UUGGCUAAUGGUUAAUACU | 2119 | AGUAUUAACCAUUAGCCAA | 2120 |
| UGGCUAAUGGUUAAUACUU | 2121 | AAGUAUUAACCAUUAGCCA | 2122 |
| CGGUGGCUCACGCCUGUAA | 2123 | UUACAGGCGUGAGCCACCG | 2124 |
| GGUGGCUCACGCCUGUAAU | 2125 | AUUACAGGCGUGAGCCACC | 2126 |
| GUGGCUCACGCCUGUAAUC | 2127 | GAUUACAGGCGUGAGCCAC | 2128 |
| UGGCUCACGCCUGUAAUCC | 2129 | GGAUUACAGGCGUGAGCCA | 2130 |
| GGCUCACGCCUGUAAUCCC | 2131 | GGGAUUACAGGCGUGAGCC | 2132 |
| ACGCCUGUAAUCCCAGCAC | 2133 | GUGCUGGGAUUACAGGCGU | 2134 |
| AGCACUUUGGGAGGCUGAG | 2135 | CUCAGCCUCCCAAAGUGCU | 2136 |
| CAUGGUGGCAGGUGCCUGU | 2137 | ACAGGCACCUGCCACCAUG | 2138 |
| AUGGUGGCAGGUGCCUGUA | 2139 | UACAGGCACCUGCCACCAU | 2140 |
| UGGCAGGUGCCUGUAGUCC | 2141 | GGACUACAGGCACCUGCCA | 2142 |
| GCAGGUGCCUGUAGUCCCA | 2143 | UGGGACUACAGGCACCUGC | 2144 |
| GUGCCUGUAGUCCCAGCUA | 2145 | UAGCUGGGACUACAGGCAC | 2146 |
| UAGUCCCAGCUACUCGGCA | 2147 | UGCCGAGUAGCUGGGACUA | 2148 |
| AGUCCCAGCUACUCGGCAG | 2149 | CUGCCGAGUAGCUGGGACU | 2150 |
| GAGCUUGCAGUGAGCCGAG | 2151 | CUCGGCUCACUGCAAGCUC | 2152 |
| ACUGCAUUCCAGCCUGGGU | 2153 | ACCCAGGCUGGAAUGCAGU | 2154 |
| CUGCAUUCCAGCCUGGGUG | 2155 | CACCCAGGCUGGAAUGCAG | 2156 |

TABLE 4-continued

| Sense Sequence | SEQ ID NO: | Antisense Sequence | SEQ ID NO: |
|---|---|---|---|
| UGCAUUCCAGCCUGGGUGA | 2157 | UCACCCAGGCUGGAAUGCA | 2158 |
| GCAUUCCAGCCUGGGUGAC | 2159 | GUCACCCAGGCUGGAAUGC | 2160 |
| CAUUCCAGCCUGGGUGACU | 2161 | AGUCACCCAGGCUGGAAUG | 2162 |
| AUUCCAGCCUGGGUGACUG | 2163 | CAGUCACCCAGGCUGGAAU | 2164 |
| UUCCAGCCUGGGUGACUGA | 2165 | UCAGUCACCCAGGCUGGAA | 2166 |
| UCCAGCCUGGGUGACUGAG | 2167 | CUCAGUCACCCAGGCUGGA | 2168 |
| AAGGUACAUCAGACAUGAC | 2169 | GUCAUGUCUGAUGUACCUU | 2170 |
| AGGUACAUCAGACAUGACU | 2171 | AGUCAUGUCUGAUGUACCU | 2172 |
| GGUACAUCAGACAUGACUG | 2173 | CAGUCAUGUCUGAUGUACC | 2174 |
| GUACAUCAGACAUGACUGC | 2175 | GCAGUCAUGUCUGAUGUAC | 2176 |
| AUCAGACAUGACUGCCUGC | 2177 | GCAGGCAGUCAUGUCUGAU | 2178 |
| UCAGACAUGACUGCCUGCA | 2179 | UGCAGGCAGUCAUGUCUGA | 2180 |
| CAGACAUGACUGCCUGCAU | 2181 | AUGCAGGCAGUCAUGUCUG | 2182 |
| AUGACUGCCUGCAUGAAGU | 2183 | ACUUCAUGCAGGCAGUCAU | 2184 |
| ACUGCCUGCAUGAAGUCAA | 2185 | UUGACUUCAUGCAGGCAGU | 2186 |
| CUGCCUGCAUGAAGUCAAA | 2187 | UUUGACUUCAUGCAGGCAG | 2188 |
| ACACCAGUGAAGCUCAAGU | 2189 | ACUUGAGCUUCACUGGUGU | 2190 |
| CACCAGUGAAGCUCAAGUC | 2191 | GACUUGAGCUUCACUGGUG | 2192 |
| ACCAGUGAAGCUCAAGUCA | 2193 | UGACUUGAGCUUCACUGGU | 2194 |
| GUGAAGCUCAAGUCAAGAG | 2195 | CUCUUGACUUGAGCUUCAC | 2196 |
| CUCAAGUCAAGAGCUGUGG | 2197 | CCACAGCUCUUGACUUGAG | 2198 |
| UCAAGUCAAGAGCUGUGGA | 2199 | UCCACAGCUCUUGACUUGA | 2200 |
| CAAGUCAAGAGCUGUGGAU | 2201 | AUCCACAGCUCUUGACUUG | 2202 |
| AAGUCAAGAGCUGUGGAUA | 2203 | UAUCCACAGCUCUUGACUU | 2204 |
| AGUCAAGAGCUGUGGAUAU | 2205 | AUAUCCACAGCUCUUGACU | 2206 |
| GUCAAGAGCUGUGGAUAUU | 2207 | AAUAUCCACAGCUCUUGAC | 2208 |
| CAAGAGCUGUGGAUAUUUU | 2209 | AAAAUAUCCACAGCUCUUG | 2210 |
| AAGAGCUGUGGAUAUUUUG | 2211 | CAAAAUAUCCACAGCUCUU | 2212 |
| AGAGCUGUGGAUAUUUUGU | 2213 | ACAAAAUAUCCACAGCUCU | 2214 |
| GAGCUGUGGAUAUUUUGUC | 2215 | GACAAAAUAUCCACAGCUC | 2216 |
| AGCUGUGGAUAUUUUGUCU | 2217 | AGACAAAAUAUCCACAGCU | 2218 |
| GCUGUGGAUAUUUUGUCUA | 2219 | UAGACAAAAUAUCCACAGC | 2220 |
| CUGUGGAUAUUUUGUCUAA | 2221 | UUAGACAAAAUAUCCACAG | 2222 |
| UGUGGAUAUUUUGUCUAAC | 2223 | GUUAGACAAAAUAUCCACA | 2224 |
| GUGGAUAUUUUGUCUAACC | 2225 | GGUUAGACAAAAUAUCCAC | 2226 |
| UGGAUAUUUUGUCUAACCA | 2227 | UGGUUAGACAAAAUAUCCA | 2228 |
| GGAUAUUUUGUCUAACCAA | 2229 | UUGGUUAGACAAAAUAUCC | 2230 |
| UCGUAUCCAGCCAAAAGAU | 2231 | AUCUUUUGGCUGGAUACGA | 2232 |
| CGUAUCCAGCCAAAAGAUG | 2233 | CAUCUUUUGGCUGGAUACG | 2234 |

TABLE 4-continued

| Sense Sequence | SEQ ID NO: | Antisense Sequence | SEQ ID NO: |
|---|---|---|---|
| GUAUCCAGCCAAAAGAUGC | 2235 | GCAUCUUUUGGCUGGAUAC | 2236 |
| UAUCCAGCCAAAAGAUGCA | 2237 | UGCAUCUUUUGGCUGGAUA | 2238 |
| AUCCAGCCAAAAGAUGCAU | 2239 | AUGCAUCUUUUGGCUGGAU | 2240 |
| AGCCAAAAGAUGCAUGAUG | 2241 | CAUCAUGCAUCUUUUGGCU | 2242 |
| GCCAAAAGAUGCAUGAUGA | 2243 | UCAUCAUGCAUCUUUUGGC | 2244 |
| CCAAAAGAUGCAUGAUGAU | 2245 | AUCAUCAUGCAUCUUUUGG | 2246 |
| CAAAAGAUGCAUGAUGAUG | 2247 | CAUCAUCAUGCAUCUUUUG | 2248 |
| AAAAGAUGCAUGAUGAUGG | 2249 | CCAUCAUCAUGCAUCUUUU | 2250 |
| AAAGAUGCAUGAUGAUGGA | 2251 | UCCAUCAUCAUGCAUCUUU | 2252 |
| GCAUGAUGAUGGAGUGGUG | 2253 | CACCACUCCAUCAUCAUGC | 2254 |
| CAUGAUGAUGGAGUGGUGG | 2255 | CCACCACUCCAUCAUCAUG | 2256 |
| AUGAUGAUGGAGUGGUGGG | 2257 | CCCACCACUCCAUCAUCAU | 2258 |
| GGGAAGGCCAGUUCAGUAU | 2259 | AUACUGAACUGGCCUUCCC | 2260 |
| GGAAGGCCAGUUCAGUAUC | 2261 | GAUACUGAACUGGCCUUCC | 2262 |
| GAAGGCCAGUUCAGUAUCC | 2263 | GGAUACUGAACUGGCCUUC | 2264 |
| AGGCCAGUUCAGUAUCCUA | 2265 | UAGGAUACUGAACUGGCCU | 2266 |
| GGCCAGUUCAGUAUCCUAU | 2267 | AUAGGAUACUGAACUGGCC | 2268 |
| GCCAGUUCAGUAUCCUAUU | 2269 | AAUAGGAUACUGAACUGGC | 2270 |
| CCAGUUCAGUAUCCUAUUU | 2271 | AAAUAGGAUACUGAACUGG | 2272 |
| CAGUUCAGUAUCCUAUUUA | 2273 | UAAAUAGGAUACUGAACUG | 2274 |
| AACUUCCUGAAUAAUGGAU | 2275 | AUCCAUUAUUCAGGAAGUU | 2276 |
| ACUUCCUGAAUAAUGGAUA | 2277 | UAUCCAUUAUUCAGGAAGU | 2278 |
| CUUCCUGAAUAAUGGAUAU | 2279 | AUAUCCAUUAUUCAGGAAG | 2280 |
| GAAUAAUGGAUAUAUGUGG | 2281 | CCACAUAUAUCCAUUAUUC | 2282 |
| AUAAUGGAUAUAUGUGGAG | 2283 | CUCCACAUAUAUCCAUUAU | 2284 |
| AGAUAUAUAGAUACAGCUG | 2285 | CAGCUGUAUCUAUAUAUCU | 2286 |
| GAUAUAUAGAUACAGCUGU | 2287 | ACAGCUGUAUCUAUAUAUC | 2288 |
| ACAGCUGUAAUUAUUUAGC | 2289 | GCUAAAUAAUUACAGCUGU | 2290 |
| CAGCUGUAAUUAUUUAGCC | 2291 | GGCUAAAUAAUUACAGCUG | 2292 |
| AGCUGUAAUUAUUUAGCCU | 2293 | AGGCUAAAUAAUUACAGCU | 2294 |
| GUAAUUAUUUAGCCUCAAG | 2295 | CUUGAGGCUAAAUAAUUAC | 2296 |
| AAUUAUUUAGCCUCAAGUG | 2297 | CACUUGAGGCUAAAUAAUU | 2298 |
| AUUAUUUAGCCUCAAGUGA | 2299 | UCACUUGAGGCUAAAUAAU | 2300 |
| UUUAGCCUCAAGUGACUUU | 2301 | AAAGUCACUUGAGGCUAAA | 2302 |
| AAGUGACUUUCUCCAUUGC | 2303 | GCAAUGGAGAAAGUCACUU | 2304 |
| AGUGACUUUCUCCAUUGCU | 2305 | AGCAAUGGAGAAAGUCACU | 2306 |
| GUGACUUUCUCCAUUGCUU | 2307 | AAGCAAUGGAGAAAGUCAC | 2308 |
| UUUCUCCAUUGCUUCACGC | 2309 | GCGUGAAGCAAUGGAGAAA | 2310 |
| UUCUCCAUUGCUUCACGCU | 2311 | AGCGUGAAGCAAUGGAGAA | 2312 |

TABLE 4-continued

| Sense Sequence | SEQ ID NO: | Antisense Sequence | SEQ ID NO: |
|---|---|---|---|
| UCUCCAUUGCUUCACGCUA | 2313 | UAGCGUGAAGCAAUGGAGA | 2314 |
| CUCCAUUGCUUCACGCUAU | 2315 | AUAGCGUGAAGCAAUGGAG | 2316 |
| UCCAUUGCUUCACGCUAUG | 2317 | CAUAGCGUGAAGCAAUGGA | 2318 |
| CCAUUGCUUCACGCUAUGC | 2319 | GCAUAGCGUGAAGCAAUGG | 2320 |
| CAUUGCUUCACGCUAUGCC | 2321 | GGCAUAGCGUGAAGCAAUG | 2322 |
| AUUGCUUCACGCUAUGCCA | 2323 | UGGCAUAGCGUGAAGCAAU | 2324 |
| UUGCUUCACGCUAUGCCAC | 2325 | GUGGCAUAGCGUGAAGCAA | 2326 |
| UGCUUCACGCUAUGCCACU | 2327 | AGUGGCAUAGCGUGAAGCA | 2328 |
| GCUUCACGCUAUGCCACUA | 2329 | UAGUGGCAUAGCGUGAAGC | 2330 |
| CUUCACGCUAUGCCACUAU | 2331 | AUAGUGGCAUAGCGUGAAG | 2332 |
| UUCACGCUAUGCCACUAUU | 2333 | AAUAGUGGCAUAGCGUGAA | 2334 |
| UCACGCUAUGCCACUAUUU | 2335 | AAAUAGUGGCAUAGCGUGA | 2336 |
| CACGCUAUGCCACUAUUUU | 2337 | AAAAUAGUGGCAUAGCGUG | 2338 |
| CGCUAUGCCACUAUUUUGC | 2339 | GCAAAAUAGUGGCAUAGCG | 2340 |
| GCUAUGCCACUAUUUUGCU | 2341 | AGCAAAAUAGUGGCAUAGC | 2342 |
| CUAUGCCACUAUUUUGCUU | 2343 | AAGCAAAAUAGUGGCAUAG | 2344 |
| UAUGCCACUAUUUUGCUUC | 2345 | GAAGCAAAAUAGUGGCAUA | 2346 |
| AUGCCACUAUUUUGCUUCU | 2347 | AGAAGCAAAAUAGUGGCAU | 2348 |
| UGCCACUAUUUUGCUUCUU | 2349 | AAGAAGCAAAAUAGUGGCA | 2350 |
| AACCUUGCUUAGUAUUCUA | 2351 | UAGAAUACUAAGCAAGGUU | 2352 |
| CCUUGCUUAGUAUUCUAUA | 2353 | UAUAGAAUACUAAGCAAGG | 2354 |
| AGUAUUCUAUAGUUUGCCC | 2355 | GGGCAAACUAUAGAAUACU | 2356 |
| GUAUUCUAUAGUUUGCCCA | 2357 | UGGGCAAACUAUAGAAUAC | 2358 |
| UAUUCUAUAGUUUGCCCAA | 2359 | UUGGGCAAACUAUAGAAUA | 2360 |
| AUUCUAUAGUUUGCCCAAC | 2361 | GUUGGGCAAACUAUAGAAU | 2362 |
| UAUAGUUUGCCCAACCAGU | 2363 | ACUGGUUGGGCAAACUAUA | 2364 |
| AUAGUUUGCCCAACCAGUU | 2365 | AACUGGUUGGGCAAACUAU | 2366 |
| UAGUUUGCCCAACCAGUUU | 2367 | AAACUGGUUGGGCAAACUA | 2368 |
| AGUUUGCCCAACCAGUUUU | 2369 | AAAACUGGUUGGGCAAACU | 2370 |
| GUUUGCCCAACCAGUUUUA | 2371 | UAAAACUGGUUGGGCAAAC | 2372 |
| UUUGCCCAACCAGUUUUAC | 2373 | GUAAAACUGGUUGGGCAAA | 2374 |
| UUGCCCAACCAGUUUUACG | 2375 | CGUAAAACUGGUUGGGCAA | 2376 |
| UGCCCAACCAGUUUUACGU | 2377 | ACGUAAAACUGGUUGGGCA | 2378 |
| GCCCAACCAGUUUUACGUC | 2379 | GACGUAAAACUGGUUGGGC | 2380 |
| CCCAACCAGUUUUACGUCC | 2381 | GGACGUAAAACUGGUUGGG | 2382 |
| CCAACCAGUUUUACGUCCA | 2383 | UGGACGUAAAACUGGUUGG | 2384 |
| CAACCAGUUUUACGUCCAA | 2385 | UUGGACGUAAAACUGGUUG | 2386 |
| AACCAGUUUUACGUCCAAG | 2387 | CUUGGACGUAAAACUGGUU | 2388 |
| GCCAAUGCAUAAAAUAUAC | 2389 | GUAUAUUUUAUGCAUUGGC | 2390 |

TABLE 4-continued

| Sense Sequence | SEQ ID NO: | Antisense Sequence | SEQ ID NO: |
|---|---|---|---|
| AACUAGGUGUCAGGGUUUA | 2391 | UAAACCCUGACACCUAGUU | 2392 |
| ACUAGGUGUCAGGGUUUAU | 2393 | AUAAACCCUGACACCUAGU | 2394 |
| CUAGGUGUCAGGGUUUAUC | 2395 | GAUAAACCCUGACACCUAG | 2396 |
| UAGGUGUCAGGGUUUAUCA | 2397 | UGAUAAACCCUGACACCUA | 2398 |
| AGGUGUCAGGGUUUAUCAA | 2399 | UUGAUAAACCCUGACACCU | 2400 |
| GGUGUCAGGGUUUAUCAAG | 2401 | CUUGAUAAACCCUGACACC | 2402 |
| GUGUCAGGGUUUAUCAAGA | 2403 | UCUUGAUAAACCCUGACAC | 2404 |
| UGUCAGGGUUUAUCAAGAA | 2405 | UUCUUGAUAAACCCUGACA | 2406 |
| GUCAGGGUUUAUCAAGAAG | 2407 | CUUCUUGAUAAACCCUGAC | 2408 |
| GGUUUAUCAAGAAGGCCAG | 2409 | CUGGCCUUCUUGAUAAACC | 2410 |
| UAUCAAGAAGGCCAGGAAG | 2411 | CUUCCUGGCCUUCUUGAUA | 2412 |
| UCAAGAAGGCCAGGAAGGC | 2413 | GCCUUCCUGGCCUUCUUGA | 2414 |
| GCCAGGAAGGCCUUUUGGG | 2415 | CCCAAAAGGCCUUCCUGGC | 2416 |
| CCAGGAAGGCCUUUUGGGU | 2417 | ACCCAAAAGGCCUUCCUGG | 2418 |
| CAGGAAGGCCUUUUGGGUU | 2419 | AACCCAAAAGGCCUUCCUG | 2420 |
| AGGAAGGCCUUUUGGGUUA | 2421 | UAACCCAAAAGGCCUUCCU | 2422 |
| GGAAGGCCUUUUGGGUUAA | 2423 | UUAACCCAAAAGGCCUUCC | 2424 |
| GAAGGCCUUUUGGGUUAAG | 2425 | CUUAACCCAAAAGGCCUUC | 2426 |
| AAGGCCUUUUGGGUUAAGC | 2427 | GCUUAACCCAAAAGGCCUU | 2428 |
| AGGCCUUUUGGGUUAAGCC | 2429 | GGCUUAACCCAAAAGGCCU | 2430 |
| GGCCUUUUGGGUUAAGCCU | 2431 | AGGCUUAACCCAAAAGGCC | 2432 |
| UUCCAAAUGAAUGGUCUCU | 2433 | AGAGACCAUUCAUUUGGAA | 2434 |
| UCCAAAUGAAUGGUCUCUG | 2435 | CAGAGACCAUUCAUUUGGA | 2436 |
| CCAAAUGAAUGGUCUCUGG | 2437 | CCAGAGACCAUUCAUUUGG | 2438 |
| CAAAUGAAUGGUCUCUGGU | 2439 | ACCAGAGACCAUUCAUUUG | 2440 |
| AAAUGAAUGGUCUCUGGUC | 2441 | GACCAGAGACCAUUCAUUU | 2442 |
| AAUGAAUGGUCUCUGGUCA | 2443 | UGACCAGAGACCAUUCAUU | 2444 |
| AUGAAUGGUCUCUGGUCAA | 2445 | UUGACCAGAGACCAUUCAU | 2446 |
| UGAAUGGUCUCUGGUCAAA | 2447 | UUUGACCAGAGACCAUUCA | 2448 |
| GAAUGGUCUCUGGUCAAAU | 2449 | AUUUGACCAGAGACCAUUC | 2450 |
| AAUGGUCUCUGGUCAAAUG | 2451 | CAUUUGACCAGAGACCAUU | 2452 |
| GUCAAAUGAAUGAAUGGUC | 2453 | GACCAUUCAUUCAUUUGAC | 2454 |
| UCAAAUGAAUGAAUGGUCA | 2455 | UGACCAUUCAUUCAUUUGA | 2456 |
| CAAAUGAAUGAAUGGUCAA | 2457 | UUGACCAUUCAUUCAUUUG | 2458 |
| AUGAAUGAAUGGUCAAAUG | 2459 | CAUUUGACCAUUCAUUCAU | 2460 |
| GGUCAAAUGAAUAAAUCUG | 2461 | CAGAUUUAUUCAUUUGACC | 2462 |
| GUCAAAUGAAUAAAUCUGC | 2463 | GCAGAUUUAUUCAUUUGAC | 2464 |
| UCAAAUGAAUAAAUCUGCC | 2465 | GGCAGAUUUAUUCAUUUGA | 2466 |
| CAAAUGAAUAAAUCUGCCC | 2467 | GGGCAGAUUUAUUCAUUUG | 2468 |

TABLE 4-continued

| Sense Sequence | SEQ ID NO: | Antisense Sequence | SEQ ID NO: |
| --- | --- | --- | --- |
| AAAUGAAUAAAUCUGCCCU | 2469 | AGGGCAGAUUUAUUCAUUU | 2470 |
| AAUGAAUAAAUCUGCCCUC | 2471 | GAGGGCAGAUUUAUUCAUU | 2472 |
| AUGAAUAAAUCUGCCCUCA | 2473 | UGAGGGCAGAUUUAUUCAU | 2474 |
| GAAUAAAUCUGCCCUCACA | 2475 | UGUGAGGGCAGAUUUAUUC | 2476 |
| AAUAAAUCUGCCCUCACAG | 2477 | CUGUGAGGGCAGAUUUAUU | 2478 |
| UCAUACCAUUUGGUUUAAG | 2479 | CUUAAACCAAAUGGUAUGA | 2480 |
| AUACCAUUUGGUUUAAGCC | 2481 | GGCUUAAACCAAAUGGUAU | 2482 |
| UACCAUUUGGUUUAAGCCU | 2483 | AGGCUUAAACCAAAUGGUA | 2484 |
| ACCAUUUGGUUUAAGCCUU | 2485 | AAGGCUUAAACCAAAUGGU | 2486 |
| CCAUUUGGUUUAAGCCUUA | 2487 | UAAGGCUUAAACCAAAUGG | 2488 |
| CAUUUGGUUUAAGCCUUAC | 2489 | GUAAGGCUUAAACCAAAUG | 2490 |
| AUUUGGUUUAAGCCUUACA | 2491 | UGUAAGGCUUAAACCAAAU | 2492 |
| GUUUAAGCCUUACAUUCAU | 2493 | AUGAAUGUAAGGCUUAAAC | 2494 |
| UUUAAGCCUUACAUUCAUG | 2495 | CAUGAAUGUAAGGCUUAAA | 2496 |
| UUCCAAAUGAAGUCGAAUC | 2497 | GAUUCGACUUCAUUUGGAA | 2498 |
| UCCAAAUGAAGUCGAAUCU | 2499 | AGAUUCGACUUCAUUUGGA | 2500 |
| CCAAAUGAAGUCGAAUCUG | 2501 | CAGAUUCGACUUCAUUUGG | 2502 |
| AAAUGAAGUCGAAUCUGCC | 2503 | GGCAGAUUCGACUUCAUUU | 2504 |
| AAUGAAGUCGAAUCUGCCC | 2505 | GGGCAGAUUCGACUUCAUU | 2506 |
| AUGAAGUCGAAUCUGCCCU | 2507 | AGGGCAGAUUCGACUUCAU | 2508 |
| UGAAGUCGAAUCUGCCCUC | 2509 | GAGGGCAGAUUCGACUUCA | 2510 |
| GAAGUCGAAUCUGCCCUCA | 2511 | UGAGGGCAGAUUCGACUUC | 2512 |
| AAGUCGAAUCUGCCCUCAC | 2513 | GUGAGGGCAGAUUCGACUU | 2514 |
| AGUCGAAUCUGCCCUCACA | 2515 | UGUGAGGGCAGAUUCGACU | 2516 |
| GUCGAAUCUGCCCUCACAG | 2517 | CUGUGAGGGCAGAUUCGAC | 2518 |
| UUGUAUUGUGUAUUUUCGG | 2519 | CCGAAAAUACACAAUACAA | 2520 |
| UGUAUUGUGUAUUUUCGGU | 2521 | ACCGAAAAUACACAAUACA | 2522 |
| GUAUUGUGUAUUUUCGGUU | 2523 | AACCGAAAAUACACAAUAC | 2524 |
| AAAUAUUUAGAUGCAGCAC | 2525 | GUGCUGCAUCUAAAUAUUU | 2526 |
| AUUUAGAUGCAGCACCAUA | 2527 | UAUGGUGCUGCAUCUAAAU | 2528 |
| UUUAGAUGCAGCACCAUAU | 2529 | AUAUGGUGCUGCAUCUAAA | 2530 |
| UUAGAUGCAGCACCAUAUU | 2531 | AAUAUGGUGCUGCAUCUAA | 2532 |
| UAGAUGCAGCACCAUAUUU | 2533 | AAAUAUGGUGCUGCAUCUA | 2534 |
| AGAUGCAGCACCAUAUUUU | 2535 | AAAAUAUGGUGCUGCAUCU | 2536 |
| GAUGCAGCACCAUAUUUUA | 2537 | UAAAAUAUGGUGCUGCAUC | 2538 |
| AUGCAGCACCAUAUUUUAU | 2539 | AUAAAAUAUGGUGCUGCAU | 2540 |
| AGCACCAUAUUUUAUAACC | 2541 | GGUUAUAAAAUAUGGUGCU | 2542 |
| GCACCAUAUUUUAUAACCC | 2543 | GGGUUAUAAAAUAUGGUGC | 2544 |
| ACCAUAUUUUAUAACCCAG | 2545 | CUGGGUUAUAAAAUAUGGU | 2546 |

TABLE 4-continued

| Sense Sequence | SEQ ID NO: | Antisense Sequence | SEQ ID NO: |
|---|---|---|---|
| CCAUAUUUUAUAACCCAGC | 2547 | GCUGGGUUAUAAAAUAUGG | 2548 |
| CAUAUUUUAUAACCCAGCU | 2549 | AGCUGGGUUAUAAAAUAUG | 2550 |
| UUAUAACCCAGCUUUAGCA | 2551 | UGCUAAAGCUGGGUUAUAA | 2552 |
| ACCCAGCUUUAGCAUUUCU | 2553 | AGAAAUGCUAAAGCUGGGU | 2554 |
| CCAGCUUUAGCAUUUCUUC | 2555 | GAAGAAAUGCUAAAGCUGG | 2556 |
| GGCGCUUCUUGCUCUCUGA | 2557 | UCAGAGAGCAAGAAGCGCC | 2558 |
| GCGCUUCUUGCUCUCUGAA | 2559 | UUCAGAGAGCAAGAAGCGC | 2560 |
| AAAUGCCCUGCUAAAUGCU | 2561 | AGCAUUUAGCAGGGCAUUU | 2562 |
| AAUGCCCUGCUAAAUGCUU | 2563 | AAGCAUUUAGCAGGGCAUU | 2564 |
| AUGCCCUGCUAAAUGCUUC | 2565 | GAAGCAUUUAGCAGGGCAU | 2566 |
| UGCCCUGCUAAAUGCUUCU | 2567 | AGAAGCAUUUAGCAGGGCA | 2568 |
| UUUGAAUAAGGUAGUUUGG | 2569 | CCAAACUACCUUAUUCAAA | 2570 |
| UUGAAUAAGGUAGUUUGGA | 2571 | UCCAAACUACCUUAUUCAA | 2572 |
| UGAAUAAGGUAGUUUGGAA | 2573 | UUCCAAACUACCUUAUUCA | 2574 |
| GAAUAAGGUAGUUUGGAAU | 2575 | AUUCCAAACUACCUUAUUC | 2576 |
| AGGUAGUUUGGAAUAAAGA | 2577 | UCUUUAUUCCAAACUACCU | 2578 |
| GAUCACUCUACAUACAGAU | 2579 | AUCUGUAUGUAGAGUGAUC | 2580 |
| AUCACUCUACAUACAGAUA | 2581 | UAUCUGUAUGUAGAGUGAU | 2582 |
| UCACUCUACAUACAGAUAG | 2583 | CUAUCUGUAUGUAGAGUGA | 2584 |
| CACUCUACAUACAGAUAGU | 2585 | ACUAUCUGUAUGUAGAGUG | 2586 |
| ACUCUACAUACAGAUAGUA | 2587 | UACUAUCUGUAUGUAGAGU | 2588 |
| CUCUACAUACAGAUAGUAA | 2589 | UUACUAUCUGUAUGUAGAG | 2590 |
| UGUAAAUGACUGAUGUUUG | 2591 | CAAACAUCAGUCAUUUACA | 2592 |
| GUAAAUGACUGAUGUUUGC | 2593 | GCAAACAUCAGUCAUUUAC | 2594 |
| UAAAUGACUGAUGUUUGCA | 2595 | UGCAAACAUCAGUCAUUUA | 2596 |
| AAAUGACUGAUGUUUGCAU | 2597 | AUGCAAACAUCAGUCAUUU | 2598 |
| GAUGUUUGCAUUAUUAAGG | 2599 | CCUUAAUAAUGCAAACAUC | 2600 |
| ACUUGGGAUGUUGGGUCAA | 2601 | UUGACCCAACAUCCCAAGU | 2602 |
| UUGGGAUGUUGGGUCAAGA | 2603 | UCUUGACCCAACAUCCCAA | 2604 |
| UGGGAUGUUGGGUCAAGAG | 2605 | CUCUUGACCCAACAUCCCA | 2606 |
| GGGAUGUUGGGUCAAGAGG | 2607 | CCUCUUGACCCAACAUCCC | 2608 |
| AAAGUGUUAGUCAAUCCAC | 2609 | GUGGAUUGACUAACACUUU | 2610 |
| GAAGGUCAAUUAUAAUUCC | 2611 | GGAAUUAUAAUUGACCUUC | 2612 |
| CCAUAUACCUUUCUUUGAU | 2613 | AUCAAAGAAAGGUAUAUGG | 2614 |
| CAUAUACCUUUCUUUGAUG | 2615 | CAUCAAAGAAAGGUAUAUG | 2616 |
| AUAUACCUUUCUUUGAUGC | 2617 | GCAUCAAAGAAAGGUAUAU | 2618 |
| UAUACCUUUCUUUGAUGCC | 2619 | GGCAUCAAAGAAAGGUAUA | 2620 |
| ACCUUUCUUUGAUGCCACA | 2621 | UGUGGCAUCAAAGAAAGGU | 2622 |
| AGAAUACAGUUUGGGUGGC | 2623 | GCCACCCAAACUGUAUUCU | 2624 |

TABLE 4-continued

| Sense Sequence | SEQ ID NO: | Antisense Sequence | SEQ ID NO: |
|---|---|---|---|
| GAAUACAGUUUGGGUGGCC | 2625 | GGCCACCCAAACUGUAUUC | 2626 |
| AAUACAGUUUGGGUGGCCA | 2627 | UGGCCACCCAAACUGUAUU | 2628 |
| AUACAGUUUGGGUGGCCAU | 2629 | AUGGCCACCCAAACUGUAU | 2630 |
| UACAGUUUGGGUGGCCAUG | 2631 | CAUGGCCACCCAAACUGUA | 2632 |
| ACAGUUUGGGUGGCCAUGG | 2633 | CCAUGGCCACCCAAACUGU | 2634 |
| CAGUUUGGGUGGCCAUGGA | 2635 | UCCAUGGCCACCCAAACUG | 2636 |
| AGUUUGGGUGGCCAUGGAU | 2637 | AUCCAUGGCCACCCAAACU | 2638 |
| GUUUGGGUGGCCAUGGAUG | 2639 | CAUCCAUGGCCACCCAAAC | 2640 |
| UUUGGGUGGCCAUGGAUGU | 2641 | ACAUCCAUGGCCACCCAAA | 2642 |
| UCAGAUCAUUUCAUGGAAU | 2643 | AUUCCAUGAAAUGAUCUGA | 2644 |
| CAGAUCAUUUCAUGGAAUC | 2645 | GAUUCCAUGAAAUGAUCUG | 2646 |
| GAUCAUUUCAUGGAAUCUU | 2647 | AAGAUUCCAUGAAAUGAUC | 2648 |
| AAGUAUCUUUGACUCUAAC | 2649 | GUUAGAGUCAAAGAUACUU | 2650 |
| AGUAUCUUUGACUCUAACU | 2651 | AGUUAGAGUCAAAGAUACU | 2652 |
| GUAUCUUUGACUCUAACUU | 2653 | AAGUUAGAGUCAAAGAUAC | 2654 |
| AUCUUUGACUCUAACUUUG | 2655 | CAAAGUUAGAGUCAAAGAU | 2656 |
| UCUUUGACUCUAACUUUGA | 2657 | UCAAAGUUAGAGUCAAAGA | 2658 |
| CUUUGACUCUAACUUUGAC | 2659 | GUCAAAGUUAGAGUCAAAG | 2660 |
| UUUGACUCUAACUUUGACU | 2661 | AGUCAAAGUUAGAGUCAAA | 2662 |
| UUGACUCUAACUUUGACUU | 2663 | AAGUCAAAGUUAGAGUCAA | 2664 |
| CUCUAACUUUGACUUGGUG | 2665 | CACCAAGUCAAAGUUAGAG | 2666 |
| UCUAACUUUGACUUGGUGG | 2667 | CCACCAAGUCAAAGUUAGA | 2668 |
| CUAACUUUGACUUGGUGGU | 2669 | ACCACCAAGUCAAAGUUAG | 2670 |
| UAACUUUGACUUGGUGGUG | 2671 | CACCACCAAGUCAAAGUUA | 2672 |
| ACUUUGACUUGGUGGUGGA | 2673 | UCCACCACCAAGUCAAAGU | 2674 |
| CUUUGACUUGGUGGUGGAC | 2675 | GUCCACCACCAAGUCAAAG | 2676 |
| UUUGACUUGGUGGUGGACC | 2677 | GGUCCACCACCAAGUCAAA | 2678 |
| UUGACUUGGUGGUGGACCU | 2679 | AGGUCCACCACCAAGUCAA | 2680 |
| UGACUUGGUGGUGGACCUU | 2681 | AAGGUCCACCACCAAGUCA | 2682 |
| UUGGUGGUGGACCUUCCUU | 2683 | AAGGAAGGUCCACCACCAA | 2684 |
| UGGUGGUGGACCUUCCUUG | 2685 | CAAGGAAGGUCCACCACCA | 2686 |
| GGUGGUGGACCUUCCUUGG | 2687 | CCAAGGAAGGUCCACCACC | 2688 |
| GUGGUGGACCUUCCUUGGU | 2689 | ACCAAGGAAGGUCCACCAC | 2690 |
| UGGUGGACCUUCCUUGGUU | 2691 | AACCAAGGAAGGUCCACCA | 2692 |
| GGUGGACCUUCCUUGGUUU | 2693 | AAACCAAGGAAGGUCCACC | 2694 |
| GUGGACCUUCCUUGGUUUU | 2695 | AAAACCAAGGAAGGUCCAC | 2696 |
| CAUGUAUUUUAGCAUAAGG | 2697 | CCUUAUGCUAAAAUACAUG | 2698 |
| AAAUGUGUAUGAGUUUCAG | 2699 | CUGAAACUCAUACACAUUU | 2700 |
| AAUGUGUAUGAGUUUCAGU | 2701 | ACUGAAACUCAUACACAUU | 2702 |

TABLE 4-continued

| Sense Sequence | SEQ ID NO: | Antisense Sequence | SEQ ID NO: |
|---|---|---|---|
| AUGUGUAUGAGUUUCAGUA | 2703 | UACUGAAACUCAUACACAU | 2704 |
| GUGUAUGAGUUUCAGUAGA | 2705 | UCUACUGAAACUCAUACAC | 2706 |
| UGUAUGAGUUUCAGUAGAA | 2707 | UUCUACUGAAACUCAUACA | 2708 |
| UUCCAUAAAUAUGCAGAGU | 2709 | ACUCUGCAUAUUUAUGGAA | 2710 |
| CCAUAAAUAUGCAGAGUUC | 2711 | GAACUCUGCAUAUUUAUGG | 2712 |
| UGAAUGCAUUUGCAAUUUC | 2713 | GAAAUUGCAAAUGCAUUCA | 2714 |
| GAAUGCAUUUGCAAUUUCU | 2715 | AGAAAUUGCAAAUGCAUUC | 2716 |
| AUGCAUUUGCAAUUUCUAG | 2717 | CUAGAAAUUGCAAAUGCAU | 2718 |
| UGCAUUUGCAAUUUCUAGG | 2719 | CCUAGAAAUUGCAAAUGCA | 2720 |
| GCAUUUGCAAUUUCUAGGA | 2721 | UCCUAGAAAUUGCAAAUGC | 2722 |
| CAUUUGCAAUUUCUAGGAU | 2723 | AUCCUAGAAAUUGCAAAUG | 2724 |
| UUUGCAAUUUCUAGGAUUC | 2725 | GAAUCCUAGAAAUUGCAAA | 2726 |
| UGCAAUUUCUAGGAUUCUA | 2727 | UAGAAUCCUAGAAAUUGCA | 2728 |
| GCAAUUUCUAGGAUUCUAA | 2729 | UUAGAAUCCUAGAAAUUGC | 2730 |
| UCUAAAGAAUUGAGUACAG | 2731 | CUGUACUCAAUUCUUUAGA | 2732 |
| CUAAAGAAUUGAGUACAGA | 2733 | UCUGUACUCAAUUCUUUAG | 2734 |
| AGAAUUACUGUGCCAAUAC | 2735 | GUAUUGGCACAGUAAUUCU | 2736 |
| GAAUUACUGUGCCAAUACU | 2737 | AGUAUUGGCACAGUAAUUC | 2738 |
| AAUUACUGUGCCAAUACUG | 2739 | CAGUAUUGGCACAGUAAUU | 2740 |
| CUGUGCCAAUACUGUUUUG | 2741 | CAAAACAGUAUUGGCACAG | 2742 |
| UGUGCCAAUACUGUUUUGA | 2743 | UCAAAACAGUAUUGGCACA | 2744 |
| GUGCCAAUACUGUUUUGAU | 2745 | AUCAAAACAGUAUUGGCAC | 2746 |
| GCCAAUACUGUUUUGAUAA | 2747 | UUAUCAAAACAGUAUUGGC | 2748 |

In some embodiments, the antisense nucleic acid molecules targeted to ERAP1 comprise or consist of the nucleotide sequences shown in Table 5.

TABLE 5

| Sequence | SEQ ID NO: |
|---|---|
| CGCCUUUCUGAACGCGGAUC | 2749 |
| ACGCCUUUCUGAACGCGGAU | 2750 |
| CACGCCUUUCUGAACGCGGA | 2751 |
| UGCACGCCUUUCUGAACGCG | 2752 |
| GAUCAGGCGUAGGAAGUGCA | 2753 |
| GGAUCAGGCGUAGGAAGUGC | 2754 |
| GGGAUCAGGCGUAGGAAGUG | 2755 |
| GAAGCUGCGAGGUUGCGAUG | 2756 |
| GGAAGCUGCGAGGUUGCGAU | 2757 |
| GGGAAUUGGUAAAUGAGCGC | 2758 |

TABLE 5-continued

| Sequence | SEQ ID NO: |
|---|---|
| AGGGAAUUGGUAAAUGAGCG | 2759 |
| GAAGGGAAUUGGUAAAUGAG | 2760 |
| GGAAGGGAAUUGGUAAAUGA | 2761 |
| CCAGGAAGGGAAUUGGUAAA | 2762 |
| CCCAGGAAGGGAAUUGGUAA | 2763 |
| AAGCCGCAACUCCCAGGAAG | 2764 |
| GAAGCCGCAACUCCCAGGAA | 2765 |
| AAAGGGUAAACGGGAGUGGG | 2766 |
| GAAAGGGUAAACGGGAGUGG | 2767 |
| GGAAAGGGUAAACGGGAGUG | 2768 |
| GAAAGUGAAAGUGGAGCCCG | 2769 |
| GGACCGAAAGUGAAAGUGGA | 2770 |

89

TABLE 5-continued

| Sequence | SEQ ID NO: |
|---|---|
| AGGACCGAAAGUGAAAGUGG | 2771 |
| CAGGACCGAAAGUGAAAGUG | 2772 |
| CCAGGACCGAAAGUGAAAGU | 2773 |
| UCUUGCUCUACCUACCUGGG | 2774 |
| UUCUUGCUCUACCUACCUGG | 2775 |
| CUUCUUGCUCUACCUACCUG | 2776 |
| CACCAUCUUCUUGCUCUACC | 2777 |
| ACACCAUCUUCUUGCUCUAC | 2778 |
| AACACCAUCUUCUUGCUCUA | 2779 |
| AAACACCAUCUUCUUGCUCU | 2780 |
| GUUAAGAGAGCCAACAGUGA | 2781 |
| AGUUAAGAGAGCCAACAGUG | 2782 |
| ACACAGUUAAGAGAGCCAAC | 2783 |
| UGGACACAGUUAAGAGAGCC | 2784 |
| AGUGGACACAGUUAAGAGAG | 2785 |
| UGAAGGAGUGGACACAGUUA | 2786 |
| AUGAAGGAGUGGACACAGUU | 2787 |
| ACCAUGAAGGAGUGGACACA | 2788 |
| ACACCAUGAAGGAGUGGACA | 2789 |
| GACACCAUGAAGGAGUGGAC | 2790 |
| UGACACCAUGAAGGAGUGGA | 2791 |
| CUGACACCAUGAAGGAGUGG | 2792 |
| CUCUGACACCAUGAAGGAGU | 2793 |
| GCUCUGACACCAUGAAGGAG | 2794 |
| UGCUCUGACACCAUGAAGGA | 2795 |
| GUGCUCUGACACCAUGAAGG | 2796 |
| GGAGAUGCUUCAGUGCUCUG | 2797 |
| UGGAGAUGCUUCAGUGCUCU | 2798 |
| GUUUUGGAGAUGCUUCAGUG | 2799 |
| UACGUUUUGGAGAUGCUUCA | 2800 |
| CUACGUUUUGGAGAUGCUUC | 2801 |
| ACUACGUUUUGGAGAUGCUU | 2802 |
| CACUACGUUUUGGAGAUGCU | 2803 |
| AUCACUACGUUUUGGAGAUG | 2804 |
| CAUCACUACGUUUUGGAGAU | 2805 |
| CCAUCACUACGUUUUGGAGA | 2806 |
| CCCAUCACUACGUUUUGGAG | 2807 |
| UCCCAUCACUACGUUUUGGA | 2808 |
| GUCCCAUCACUACGUUUUGG | 2809 |

90

TABLE 5-continued

| Sequence | SEQ ID NO: |
|---|---|
| UGUCCCAUCACUACGUUUUG | 2810 |
| GUGUCCCAUCACUACGUUUU | 2811 |
| GGUGUCCCAUCACUACGUUU | 2812 |
| UGGUGUCCCAUCACUACGUU | 2813 |
| AUUCCAAGGAAAUGGUGUCC | 2814 |
| UAUUCCAAGGAAAUGGUGUC | 2815 |
| GAUCAUAAUGAACUGGGAUG | 2816 |
| GAGAUCAUAAUGAACUGGGA | 2817 |
| AGAGAUCAUAAUGAACUGGG | 2818 |
| GUCAGCGUGGUAAGGUUUGC | 2819 |
| GGUCAGCGUGGUAAGGUUUG | 2820 |
| AGGUCAGCGUGGUAAGGUUU | 2821 |
| AAGGUCAGCGUGGUAAGGUU | 2822 |
| GAAGGUCAGCGUGGUAAGGU | 2823 |
| AGAAGGUCAGCGUGGUAAGG | 2824 |
| CCAGAAGGUCAGCGUGGUAA | 2825 |
| CCCAGAAGGUCAGCGUGGUA | 2826 |
| UUUCUACUUUCGUGGUUCCC | 2827 |
| AUUUCUACUUUCGUGGUUCC | 2828 |
| GAUUUCUACUUUCGUGGUUC | 2829 |
| GUGAUUUCUACUUUCGUGGU | 2830 |
| ACUGGCUGUGAUUUCUACUU | 2831 |
| GACUGGCUGUGAUUUCUACU | 2832 |
| CUGACUGGCUGUGAUUUCUA | 2833 |
| UGCAGGAUGAUGGUGCUGGU | 2834 |
| AUGCAGGAUGAUGGUGCUGG | 2835 |
| CUAUGCAGGAUGAUGGUGCU | 2836 |
| UGACUAUGCAGGAUGAUGGU | 2837 |
| GUGACUAUGCAGGAUGAUGG | 2838 |
| GGUGACUAUGCAGGAUGAUG | 2839 |
| UGGUGACUAUGCAGGAUGAU | 2840 |
| GUGGUGACUAUGCAGGAUGA | 2841 |
| GGUGGUGACUAUGCAGGAUG | 2842 |
| AGGUGGUGACUAUGCAGGAU | 2843 |
| CAGGUGGUGACUAUGCAGGA | 2844 |
| GCAGGUGGUGACUAUGCAGG | 2845 |
| UCCGAUAGCCUCUCUCCAGC | 2846 |
| UUCCGAUAGCCUCUCUCCAG | 2847 |
| CUUCCGAUAGCCUCUCUCCA | 2848 |

TABLE 5-continued

| Sequence | SEQ ID NO: |
|----------|------------|
| UCUUCCGAUAGCCUCUCUCC | 2849 |
| UUCUUCCGAUAGCCUCUCUC | 2850 |
| GUUCUUCCGAUAGCCUCUCU | 2851 |
| GGUUCUUCCGAUAGCCUCUC | 2852 |
| GGGUUCUUCCGAUAGCCUCU | 2853 |
| GAGCCAGCAGUGCAAUUUGC | 2854 |
| UCGGGAGCCAGCAGUGCAAU | 2855 |
| UGUGUACGGGAGCCCGACAA | 2856 |
| AACUGUGUACGGGAGCCCGA | 2857 |
| ACAACUGUGUACGGGAGCCC | 2858 |
| GACAACUGUGUACGGGAGCC | 2859 |
| UGACAACUGUGUACGGGAGC | 2860 |
| AUGACAACUGUGUACGGGAG | 2861 |
| AAUGACAACUGUGUACGGGA | 2862 |
| GAAUGACAACUGUGUACGGG | 2863 |
| GUGAAUGACAACUGUGUACG | 2864 |
| CAUAGUGAAUGACAACUGUG | 2865 |
| GCAUAGUGAAUGACAACUGU | 2866 |
| AGCAUAGUGAAUGACAACUG | 2867 |
| CAGCAUAGUGAAUGACAACU | 2868 |
| CCAGCAUAGUGAAUGACAAC | 2869 |
| GCCAGCAUAGUGAAUGACAA | 2870 |
| UGCCAGCAUAGUGAAUGACA | 2871 |
| UUGCCAGCAUAGUGAAUGAC | 2872 |
| AAAGAUUGCCAGCAUAGUGA | 2873 |
| GAAAGAUUGCCAGCAUAGUG | 2874 |
| UAAAAUCCGUGGAAAGUCUC | 2875 |
| GUAAAAUCCGUGGAAAGUCU | 2876 |
| UGUAAAAUCCGUGGAAAGUC | 2877 |
| GCUUUUGUAAAAUCCGUGGA | 2878 |
| UGCUUUUGUAAAAUCCGUGG | 2879 |
| AGGUGCUUUUGUAAAAUCCG | 2880 |
| GUUCUGUAGGUGCUUUUGUA | 2881 |
| GGUUCUGUAGGUGCUUUUGU | 2882 |
| UUCCUUGGUUCUGUAGGUGC | 2883 |
| CUUCCUUGGUUCUGUAGGUG | 2884 |
| CCCUUCCUUGGUUCUGUAGG | 2885 |
| UGCUAGUAUCCUCAGUUCCC | 2886 |
| AUGCUAGUAUCCUCAGUUCC | 2887 |

TABLE 5-continued

| Sequence | SEQ ID NO: |
|----------|------------|
| GAUGCUAGUAUCCUCAGUUC | 2888 |
| UGAUGCUAGUAUCCUCAGUU | 2889 |
| UUGAUGCUAGUAUCCUCAGU | 2890 |
| GUUGAUGCUAGUAUCCUCAG | 2891 |
| UGUUGAUGCUAGUAUCCUCA | 2892 |
| GUGUUGAUGCUAGUAUCCUC | 2893 |
| AGGGAAAGGCCAUUCUAGCU | 2894 |
| CAGGGAAAGGCCAUUCUAGC | 2895 |
| AAAGCAGGGAAAGGCCAUUC | 2896 |
| CAUCAAAGCAGGGAAAGGCC | 2897 |
| GUUCAUCAAAGCAGGGAAAG | 2898 |
| CAGGUUCAUCAAAGCAGGGA | 2899 |
| AGGCAGGUUCAUCAAAGCAG | 2900 |
| AAGGCAGGUUCAUCAAAGCA | 2901 |
| GAAGGCAGGUUCAUCAAAGC | 2902 |
| AAACUUGCUUUGAAGGCAGG | 2903 |
| GAAACUUGCUUUGAAGGCAG | 2904 |
| AGAAACUUGCUUUGAAGGCA | 2905 |
| UGCCUUGGCUCUCUUCUAAU | 2906 |
| GUGCCUUGGCUCUCUUCUAA | 2907 |
| UAGGUGCCUUGGCUCUCUUC | 2908 |
| UGGCUAGGUGCCUUGGCUCU | 2909 |
| AUGGCUAGGUGCCUUGGCUC | 2910 |
| GAUGGCUAGGUGCCUUGGCU | 2911 |
| AGAUGGCUAGGUGCCUUGGC | 2912 |
| GAGAUGGCUAGGUGCCUUGG | 2913 |
| GGAGAUGGCUAGGUGCCUUG | 2914 |
| UUGGAGAUGGCUAGGUGCCU | 2915 |
| AUUGGAGAUGGCUAGGUGCC | 2916 |
| UAUUGGAGAUGGCUAGGUGC | 2917 |
| CAUAUUGGAGAUGGCUAGGU | 2918 |
| GCAUAUUGGAGAUGGCUAGG | 2919 |
| GGCAUAUUGGAGAUGGCUAG | 2920 |
| AUGGCAUAUUGGAGAUGGCU | 2921 |
| CAGAUUUCACCAUGGCAUA | 2922 |
| ACAGAUUUCACCAUGGCAU | 2923 |
| CACAGAUUUCACCAUGGCA | 2924 |
| UCACAGAUUUCACCAUGGC | 2925 |
| GUCACAGAUUUCACCAUGG | 2926 |

TABLE 5-continued

| Sequence | SEQ ID NO: |
|----------|------------|
| AGUCACAGAUUUCACCAAUG | 2927 |
| CAGUCACAGAUUUCACCAAU | 2928 |
| ACAGUCACAGAUUUCACCAA | 2929 |
| UUCAGCAACAGUCACAGAUU | 2930 |
| CUUCAGCAACAGUCACAGAU | 2931 |
| GUCCUUCAGCAACAGUCACA | 2932 |
| AGUCCUUCAGCAACAGUCAC | 2933 |
| GAGUCCUUCAGCAACAGUCA | 2934 |
| CUAUGAGUCCUUCAGCAACA | 2935 |
| UCUAUGAGUCCUUCAGCAAC | 2936 |
| UUCUAUGAGUCCUUCAGCAA | 2937 |
| CUUCUAUGAGUCCUUCAGCA | 2938 |
| GUCUUCUAUGAGUCCUUCAG | 2939 |
| AAUGGUCUUCUAUGAGUCCU | 2940 |
| AAAUGGUCUUCUAUGAGUCC | 2941 |
| UCACAGUGACAUCAAAAUGG | 2942 |
| UCAUCUUCACAGUGACAUCA | 2943 |
| GCUCAUCUUCACAGUGACAU | 2944 |
| UGCUCAUCUUCACAGUGACA | 2945 |
| GGUGCUCAUCUUCACAGUGA | 2946 |
| AGGUGCUCAUCUUCACAGUG | 2947 |
| AUAGGUGCUCAUCUUCACAG | 2948 |
| GAUAGGUGCUCAUCUUCACA | 2949 |
| AUGAAGGCCACCAGAUAGGU | 2950 |
| UGAUGAAGGCCACCAGAUAG | 2951 |
| AUGAUGAAGGCCACCAGAUA | 2952 |
| AAUGAUGAAGGCCACCAGAU | 2953 |
| GAAAUGAUGAAGGCCACCAG | 2954 |
| UGAAAUGAUGAAGGCCACCA | 2955 |
| UGCUGACAGACUCAAAAUCU | 2956 |
| UCUUGCUGACAGACUCAAAA | 2957 |
| GUUAUCUUGCUGACAGACUC | 2958 |
| GGUUAUCUUGCUGACAGACU | 2959 |
| UGGUUAUCUUGCUGACAGAC | 2960 |
| CUUGGUUAUCUUGCUGACAG | 2961 |
| CUCUUGGUUAUCUUGCUGAC | 2962 |
| ACUCUUGGUUAUCUUGCUGA | 2963 |
| CACUCUUGGUUAUCUUGCUG | 2964 |
| CCACUCUUGGUUAUCUUGCU | 2965 |

TABLE 5-continued

| Sequence | SEQ ID NO: |
|----------|------------|
| GACUCCACUCUUGGUUAUCU | 2966 |
| UGACUCCACUCUUGGUUAUC | 2967 |
| UUGACUCCACUCUUGGUUAU | 2968 |
| CUUGACUCCACUCUUGGUUA | 2969 |
| ACCUUGACUCCACUCUUGGU | 2970 |
| AACCUUGACUCCACUCUUGG | 2971 |
| AAACCUUGACUCCACUCUUG | 2972 |
| AGAAACCUUGACUCCACUCU | 2973 |
| CAGAAACCUUGACUCCACUC | 2974 |
| AAACAGAAACCUUGACUCCA | 2975 |
| UAAACAGAAACCUUGACUCC | 2976 |
| GCAUAAACAGAAACCUUGAC | 2977 |
| CAGCAUAAACAGAAACCUUG | 2978 |
| UCUUGUCUGGCACAGCAUAA | 2979 |
| CAGUGCAUAAUCUGCUUGAU | 2980 |
| CCAGUGCAUAAUCUGCUUGA | 2981 |
| UCCAGUGCAUAAUCUGCUUG | 2982 |
| AUCCAGUGCAUAAUCUGCUU | 2983 |
| CAUCCAGUGCAUAAUCUGCU | 2984 |
| GCAUCCAGUGCAUAAUCUGC | 2985 |
| AGCAUCCAGUGCAUAAUCUG | 2986 |
| CGCAGCAUCCAGUGCAUAAU | 2987 |
| CACCGCAGCAUCCAGUGCAU | 2988 |
| UCACCGCAGCAUCCAGUGCA | 2989 |
| AGUCACCGCAGCAUCCAGUG | 2990 |
| GAGUCACCGCAGCAUCCAGU | 2991 |
| AGAGUCACCGCAGCAUCCAG | 2992 |
| AAGAGUCACCGCAGCAUCCA | 2993 |
| GAAGAGUCACCGCAGCAUCC | 2994 |
| AGAAGAGUCACCGCAGCAUC | 2995 |
| UAGAAGAGUCACCGCAGCAU | 2996 |
| CUAGAAGAGUCACCGCAGCA | 2997 |
| UCGGGAAUAGCAGCAAGAUC | 2998 |
| AAGUCGGGAAUAGCAGCAAG | 2999 |
| AAAGUCGGGAAUAGCAGCAA | 3000 |
| GAAAGUCGGGAAUAGCAGCA | 3001 |
| UGAAAGUCGGGAAUAGCAGC | 3002 |
| CUGAAAGUCGGGAAUAGCAG | 3003 |
| ACUGAAAGUCGGGAAUAGCA | 3004 |

95

TABLE 5-continued

| Sequence | SEQ ID NO: |
|---|---|
| CAUAGCACCAGACUGAAAGU | 3005 |
| UCCAUAGCACCAGACUGAAA | 3006 |
| UUCCAUAGCACCAGACUGAA | 3007 |
| UUUCCAUAGCACCAGACUGA | 3008 |
| UUUUCCAUAGCACCAGACUG | 3009 |
| GUUUUCCAUAGCACCAGACU | 3010 |
| AGUUUUCCAUAGCACCAGAC | 3011 |
| CAGUUUUCCAUAGCACCAGA | 3012 |
| CCAGUUUUCCAUAGCACCAG | 3013 |
| CUCUAUAUGUUGUCAGUCCC | 3014 |
| CUUGAUGCAGAAGACUUUUC | 3015 |
| GCUUACUUGAUGCAGAAGAC | 3016 |
| CAGUUCAUGGGCCACAGUCA | 3017 |
| GCCAGUUCAUGGGCCACAGU | 3018 |
| UAGUGACCAGGUUCCCAAAC | 3019 |
| AUAGUGACCAGGUUCCCAAA | 3020 |
| UCCAUAGUGACCAGGUUCCC | 3021 |
| UUCCAUAGUGACCAGGUUCC | 3022 |
| AUUCCAUAGUGACCAGGUUC | 3023 |
| CAUUCCAUAGUGACCAGGUU | 3024 |
| CCAUUCCAUAGUGACCAGGU | 3025 |
| ACCAUUCCAUAGUGACCAGG | 3026 |
| CACCAUUCCAUAGUGACCAG | 3027 |
| CCACCAUUCCAUAGUGACCA | 3028 |
| UCCACCAUUCCAUAGUGACC | 3029 |
| AUUCCACCAUUCCAUAGUGA | 3030 |
| AUCAUUCCACCAUUCCAUAG | 3031 |
| GAUCAUUCCACCAUUCCAUA | 3032 |
| AAGAUCAUUCCACCAUUCCA | 3033 |
| AAAGAUCAUUCCACCAUUCC | 3034 |
| CAAAGAUCAUUCCACCAUUC | 3035 |
| CCAAAGAUCAUUCCACCAUU | 3036 |
| GCCAAAGAUCAUUCCACCAU | 3037 |
| AGCCAAAGAUCAUUCCACCA | 3038 |
| UAGCCAAAGAUCAUUCCACC | 3039 |
| GACAGACACAAACUCCAUAA | 3040 |
| GUUCAGGAUGGGUCACACUG | 3041 |
| AGUUCAGGAUGGGUCACACU | 3042 |
| CAGUUCAGGAUGGGUCACAC | 3043 |

96

TABLE 5-continued

| Sequence | SEQ ID NO: |
|---|---|
| UCAGUUCAGGAUGGGUCACA | 3044 |
| CUUUCAGUUCAGGAUGGGUC | 3045 |
| AAAGCAUCUACCUCCAUUGC | 3046 |
| UUUCCACAGGUGUAGACACA | 3047 |
| UUUUCCACAGGUGUAGACAC | 3048 |
| AUUUUCCACAGGUGUAGACA | 3049 |
| AGGAUUUUCCACAGGUGUAG | 3050 |
| GCAGGAUUUUCCACAGGUGU | 3051 |
| AGCAGGAUUUUCCACAGGUG | 3052 |
| GAGCAGGAUUUUCCACAGGU | 3053 |
| UGAGCAGGAUUUUCCACAGG | 3054 |
| CUGAGCAGGAUUUUCCACAG | 3055 |
| CGGAUCUGAGCAGGAUUUUC | 3056 |
| CUCCCGGAUCUGAGCAGGAU | 3057 |
| ACAUCUCCCGGAUCUGAGCA | 3058 |
| AAACAUCUCCCGGAUCUGAG | 3059 |
| CAAACAUCUCCCGGAUCUGA | 3060 |
| UCAAACAUCUCCCGGAUCUG | 3061 |
| AUCAAACAUCUCCCGGAUCU | 3062 |
| CAUCAAACAUCUCCCGGAUC | 3063 |
| UCAUCAAACAUCUCCCGGAU | 3064 |
| CAUCAUCAAACAUCUCCCGG | 3065 |
| ACAUCAUCAAACAUCUCCCG | 3066 |
| AACAUCAUCAAACAUCUCCC | 3067 |
| GAAUACAAGCUCCCUUAUCA | 3068 |
| AGAAUACAAGCUCCCUUAUC | 3069 |
| CAGAAUACAAGCUCCCUUAU | 3070 |
| UCAGAAUACAAGCUCCCUUA | 3071 |
| UUCAGAAUACAAGCUCCCUU | 3072 |
| AUUCAGAAUACAAGCUCCCU | 3073 |
| CUCCCUUAGCAUAUUCAGAA | 3074 |
| ACUCCCUUAGCAUAUUCAGA | 3075 |
| UGCUUCUGGAGAUACUGUAC | 3076 |
| AUGCUUCUGGAGAUACUGUA | 3077 |
| UAUGCUUCUGGAGAUACUGU | 3078 |
| AUCCCACAGGUCCUCGUUUU | 3079 |
| UAUCCCACAGGUCCUCGUUU | 3080 |
| CUAUCCCACAGGUCCUCGUU | 3081 |
| UACUAUCCCACAGGUCCUCG | 3082 |

97

98

TABLE 5-continued

TABLE 5-continued

| Sequence | SEQ ID NO: |
| --- | --- |
| AUACUAUCCCACAGGUCCUC | 3083 |
| CCAUACUAUCCCACAGGUCC | 3084 |
| GCCAUACUAUCCCACAGGUC | 3085 |
| UGCCAUACUAUCCCACAGGU | 3086 |
| UUGCCAUACUAUCCCACAGG | 3087 |
| CUUGCCAUACUAUCCCACAG | 3088 |
| ACUUGCCAUACUAUCCCACA | 3089 |
| UACUUGCCAUACUAUCCCAC | 3090 |
| AUACUUGCCAUACUAUCCCA | 3091 |
| AAUACUUGCCAUACUAUCCC | 3092 |
| AUCUGUAGGGCAAAUACUUG | 3093 |
| CAUCUGUAGGGCAAAUACUU | 3094 |
| CCAUCUGUAGGGCAAAUACU | 3095 |
| ACCAUCUGUAGGGCAAAUAC | 3096 |
| CACCAUCUGUAGGGCAAAUA | 3097 |
| ACACCAUCUGUAGGGCAAAU | 3098 |
| AUCCCUUUUACACCAUCUGU | 3099 |
| AUCCAUCCCUUUUACACCAU | 3100 |
| CAUCCAUCCCUUUUACACCA | 3101 |
| CCAUCCAUCCCUUUUACACC | 3102 |
| UAGAGCAAAAGCCAUCCAUC | 3103 |
| CUAGAGCAAAAGCCAUCCAU | 3104 |
| CAAUGUGAGGAUGAAGAUGA | 3105 |
| CCAAUGUGAGGAUGAAGAUG | 3106 |
| GCCAAUGUGAGGAUGAAGAU | 3107 |
| UGCCAAUGUGAGGAUGAAGA | 3108 |
| AUGCCAAUGUGAGGAUGAAG | 3109 |
| GAUGCCAAUGUGAGGAUGAA | 3110 |
| CUGAUGCCAAUGUGAGGAUG | 3111 |
| CCUGAUGCCAAUGUGAGGAU | 3112 |
| UCAUGGUUUUCACAUCCACC | 3113 |
| AUCAUGGUUUUCACAUCCAC | 3114 |
| CAUCAUGGUUUUCACAUCCA | 3115 |
| UCAUCAUGGUUUUCACAUCC | 3116 |
| CCAAGUGUUCAUCAUGGUUU | 3117 |
| UCCAAGUGUUCAUCAUGGUU | 3118 |
| CACUGUGAUGGUUAUUAGGG | 3119 |
| CUCACUGUGAUGGUUAUUAG | 3120 |
| GUGCUCUUGCUUCAUGUGUA | 3121 |

| Sequence | SEQ ID NO: |
| --- | --- |
| AGUGCUCUUGCUUCAUGUGU | 3122 |
| UAGUGCUCUUGCUUCAUGUG | 3123 |
| GUAGUGCUCUUGCUUCAUGU | 3124 |
| UGUAGUGCUCUUGCUUCAUG | 3125 |
| AUGUAGUGCUCUUGCUUCAU | 3126 |
| CAUGUAGUGCUCUUGCUUCA | 3127 |
| CCUUCAUGUAGUGCUCUUGC | 3128 |
| CCCUUCAUGUAGUGCUCUUG | 3129 |
| GCCCUUCAUGUAGUGCUCUU | 3130 |
| AGCCCUUCAUGUAGUGCUCU | 3131 |
| AGAGCCCUUCAUGUAGUGCU | 3132 |
| CAGAGCCCUUCAUGUAGUGC | 3133 |
| UCAGAGCCCUUCAUGUAGUG | 3134 |
| CGUCAGAGCCCUUCAUGUAG | 3135 |
| CCGUCAGAGCCCUUCAUGUA | 3136 |
| AUGGAACAUGCCACAGGUAC | 3137 |
| AAUGGAACAUGCCACAGGUA | 3138 |
| CAAUGGAACAUGCCACAGGU | 3139 |
| UCAAUGGAACAUGCCACAGG | 3140 |
| GUCAAUGGAACAUGCCACAG | 3141 |
| UGUCAAUGGAACAUGCCACA | 3142 |
| UUGCUGGUGAUGAAUGUCAA | 3143 |
| CCAUUCCACCUCUUCUGGGA | 3144 |
| AAUUUGAUCCAUUCCACCUC | 3145 |
| CCAUUCAUGCCCACAUUAAA | 3146 |
| GCCAUUCAUGCCCACAUUAA | 3147 |
| AGCCAUUCAUGCCCACAUUA | 3148 |
| UAGCCAUUCAUGCCCACAUU | 3149 |
| AUAGCCAUUCAUGCCCACAU | 3150 |
| GUAAUAGCCAUUCAUGCCCA | 3151 |
| UCCUCGUAAUGCACAAUGUA | 3152 |
| AUCCUCGUAAUGCACAAUGU | 3153 |
| CAUCCUCGUAAUGCACAAUG | 3154 |
| UCAUCCUCGUAAUGCACAAU | 3155 |
| AUCAUCCUCGUAAUGCACAA | 3156 |
| CAUCAUCCUCGUAAUGCACA | 3157 |
| CCAUCAUCCUCGUAAUGCAC | 3158 |
| UCCAUCAUCCUCGUAAUGCA | 3159 |
| AUCCAUCAUCCUCGUAAUGC | 3160 |

TABLE 5-continued

| Sequence | SEQ ID NO: |
|---|---|
| CAUCCAUCAUCCUCGUAAUG | 3161 |
| CCAUCCAUCAUCCUCGUAAU | 3162 |
| CCCAUCCAUCAUCCUCGUAA | 3163 |
| GUCCCAUCCAUCAUCCUCGU | 3164 |
| AGUCCCAUCCAUCAUCCUCG | 3165 |
| GAGUCCCAUCCAUCAUCCUC | 3166 |
| CAAAGAGUCCCAUCCAUCAU | 3167 |
| UCAAAGAGUCCCAUCCAUCA | 3168 |
| AGUCAAAGAGUCCCAUCCAU | 3169 |
| CAGUCAAAGAGUCCCAUCCA | 3170 |
| CCAGUCAAAGAGUCCCAUCC | 3171 |
| GCCAGUCAAAGAGUCCCAUC | 3172 |
| GGCCAGUCAAAGAGUCCCAU | 3173 |
| AGGCCAGUCAAAGAGUCCCA | 3174 |
| AAGGCCAGUCAAAGAGUCCC | 3175 |
| AAAGGCCAGUCAAAGAGUCC | 3176 |
| UAAAAGGCCAGUCAAAGAGU | 3177 |
| UUAAAAGGCCAGUCAAAGAG | 3178 |
| UUACUGCUGACUGCUGUGUG | 3179 |
| CAUUACUGCUGACUGCUGUG | 3180 |
| UCAUUACUGCUGACUGCUGU | 3181 |
| AUCAUUACUGCUGACUGCUG | 3182 |
| GAUCAUUACUGCUGACUGCU | 3183 |
| CGAUCAUUACUGCUGACUGC | 3184 |
| CCGAUCAUUACUGCUGACUG | 3185 |
| UCAAUGGACAGCUUCCCAAU | 3186 |
| UUCAAUGGACAGCUUCCCAA | 3187 |
| UUUUCAAUGGACAGCUUCCC | 3188 |
| CUUUUCAAUGGACAGCUUCC | 3189 |
| UACAGGGAUAAAUCCAAGGC | 3190 |
| GUACAGGGAUAAAUCCAAGG | 3191 |
| AGUACAGGGAUAAAUCCAAG | 3192 |
| CAAGUACAGGGAUAAAUCCA | 3193 |
| UCAAGUACAGGGAUAAAUCC | 3194 |
| CGGGCAUAAUUUCAGUUUCA | 3195 |
| ACGGGCAUAAUUUCAGUUUC | 3196 |
| CACGGGCAUAAUUUCAGUUU | 3197 |
| ACACGGGCAUAAUUUCAGUU | 3198 |
| AACACGGGCAUAAUUUCAGU | 3199 |

TABLE 5-continued

| Sequence | SEQ ID NO: |
|---|---|
| AAACACGGGCAUAAUUUCAG | 3200 |
| CUUGAAACACGGGCAUAAUU | 3201 |
| CCUUGAAACACGGGCAUAAU | 3202 |
| ACCUUGAAACACGGGCAUAA | 3203 |
| AACCUUGAAACACGGGCAUA | 3204 |
| AAACCUUGAAACACGGGCAU | 3205 |
| CAAACCUUGAAACACGGGCA | 3206 |
| CCUUGAAUUGAGUUUCCACU | 3207 |
| GCCUUGAAUUGAGUUUCCAC | 3208 |
| GGCCUUGAAUUGAGUUUCCA | 3209 |
| UUAGCAGCCUGAUGAGGAAG | 3210 |
| GAGGUCCCUUAGCAGCCUGA | 3211 |
| AUGAGGUCCCUUAGCAGCCU | 3212 |
| UCAAUGAGGUCCCUUAGCAG | 3213 |
| AUCAAUGAGGUCCCUUAGCA | 3214 |
| UAUCAAUGAGGUCCCUUAGC | 3215 |
| UUAUCAAUGAGGUCCCUUAG | 3216 |
| UGCUUAUCAAUGAGGUCCCU | 3217 |
| CUGCUUAUCAAUGAGGUCCC | 3218 |
| UCUGCUUAUCAAUGAGGUCC | 3219 |
| GUCUGCUUAUCAAUGAGGUC | 3220 |
| UGUCUGCUUAUCAAUGAGGU | 3221 |
| CAUGUCUGCUUAUCAAUGAG | 3222 |
| CUGUCCAUGUCUGCUUAUCA | 3223 |
| UCUGUCCAUGUCUGCUUAUC | 3224 |
| UCGUCUGUCCAUGUCUGCUU | 3225 |
| CUCGUCUGUCCAUGUCUGCU | 3226 |
| GCCCUCGUCUGUCCAUGUCU | 3227 |
| AGCCCUCGUCUGUCCAUGUC | 3228 |
| GAGCCCUCGUCUGUCCAUGU | 3229 |
| CUGAGCCCUCGUCUGUCCAU | 3230 |
| ACUGAGCCCUCGUCUGUCCA | 3231 |
| ACAGGCGAGGAGUAGUAGUU | 3232 |
| CACAGGCGAGGAGUAGUAGU | 3233 |
| ACACAGGCGAGGAGUAGUAG | 3234 |
| CACACAGGCGAGGAGUAGUA | 3235 |
| GCACACAGGCGAGGAGUAGU | 3236 |
| UGCACACAGGCGAGGAGUAG | 3237 |
| UAGCCUUCUGCCCUCUGUAC | 3238 |

101

TABLE 5-continued

| Sequence | SEQ ID NO: |
|---|---|
| AAAUAGCCUUCUGCCCUCUG | 3239 |
| GAAAUAGCCUUCUGCCCUCU | 3240 |
| CUGAAAUAGCCUUCUGCCCU | 3241 |
| UUUCUGAAAUAGCCUUCUGC | 3242 |
| UUCCACUUUCUGAAAUAGCC | 3243 |
| GCUCAAGUUUCCAUUGGAUU | 3244 |
| GGCUCAAGUUUCCAUUGGAU | 3245 |
| AGGCUCAAGUUUCCAUUGGA | 3246 |
| CACUGCCAAGGUCACGUCGA | 3247 |
| ACACUGCCAAGGUCACGUCG | 3248 |
| AACACUGCCAAGGUCACGUC | 3249 |
| AAACACUGCCAAGGUCACGU | 3250 |
| CAGCAAACACUGCCAAGGUC | 3251 |
| CCACAGCAAACACUGCCAAG | 3252 |
| UAAAGAAAAUCCCAGCCUUC | 3253 |
| GUACUGGACAAAGAAAACUG | 3254 |
| UGCAGAGGGCAAAUUCAAUU | 3255 |
| AUCUAGUAGCCAUUGAAGCU | 3256 |
| CAUCUAGUAGCCAUUGAAGC | 3257 |
| UCAUCUAGUAGCCAUUGAAG | 3258 |
| CUUUCAUCUAGUAGCCAUUG | 3259 |
| GCUUUCAUCUAGUAGCCAUU | 3260 |
| AGCUUUCAUCUAGUAGCCAU | 3261 |
| CUGCCAAUGAGUGUAAGAAU | 3262 |
| CCUGCCAAUGAGUGUAAGAA | 3263 |
| UCCUGCCAAUGAGUGUAAGA | 3264 |
| UUCCUGCCAAUGAGUGUAAG | 3265 |
| GUUCCUGCCAAUGAGUGUAA | 3266 |
| GGUUCCUGCCAAUGAGUGUA | 3267 |
| GGGUUCCUGCCAAUGAGUGU | 3268 |
| UGGGUUCCUGCCAAUGAGUG | 3269 |
| UACUGGGUUCCUGCCAAUGA | 3270 |
| AUCCUACUGGGUUCCUGCCA | 3271 |
| UAUCCUACUGGGUUCCUGCC | 3272 |
| GUAUCCUACUGGGUUCCUGC | 3273 |
| GGUAUCCUACUGGGUUCCUG | 3274 |
| GGGUAUCCUACUGGGUUCCU | 3275 |
| UGGGUAUCCUACUGGGUUCC | 3276 |
| UCCUCAGAAAUUGCCAGGCC | 3277 |

102

TABLE 5-continued

| Sequence | SEQ ID NO: |
|---|---|
| UUCCUCAGAAAUUGCCAGGC | 3278 |
| AGAUGAGCCAAGUUCAAACU | 3279 |
| AAGAUGAGCCAAGUUCAAAC | 3280 |
| GAAGAUGAGCCAAGUUCAAA | 3281 |
| GGAAGAUGAGCCAAGUUCAA | 3282 |
| UGGAAGAUGAGCCAAGUUCA | 3283 |
| AUGGAAGAUGAGCCAAGUUC | 3284 |
| UGUGGGCUAUGGAAGAUGAG | 3285 |
| CCAUUACCAUGUGGGCUAUG | 3286 |
| GUUGUACCCAUUACCAUGUG | 3287 |
| UGUUGUACCCAUUACCAUGU | 3288 |
| UUGUUGUACCCAUUACCAUG | 3289 |
| AAGCCGUGUUCUUGUGGAGA | 3290 |
| CCUCUUCAAGCCGUGUUCUU | 3291 |
| ACCUCUUCAAGCCGUGUUCU | 3292 |
| UACCUCUUCAAGCCGUGUUC | 3293 |
| UUACCUCUUCAAGCCGUGUU | 3294 |
| UUUACCUCUUCAAGCCGUGU | 3295 |
| UUUUACCUCUUCAAGCCGUG | 3296 |
| CUUUUACCUCUUCAAGCCGU | 3297 |
| CCUUUUACCUCUUCAAGCCG | 3298 |
| AUCCUUUUACCUCUUCAAGC | 3299 |
| CUGAAGAAUCCUUUUACCUC | 3300 |
| GCUGAAGAAUCCUUUUACCU | 3301 |
| AGCUGAAGAAUCCUUUUACC | 3302 |
| ACGGAGCUGAGAACCAUUUU | 3303 |
| AACGGAGCUGAGAACCAUUU | 3304 |
| CAACGGAGCUGAGAACCAUU | 3305 |
| ACAACGGAGCUGAGAACCAU | 3306 |
| CACAACGGAGCUGAGAACCA | 3307 |
| ACACAACGGAGCUGAGAACC | 3308 |
| GACACAACGGAGCUGAGAAC | 3309 |
| GGACACAACGGAGCUGAGAA | 3310 |
| UGGACACAACGGAGCUGAGA | 3311 |
| UUGGACACAACGGAGCUGAG | 3312 |
| ACCGAUGUUUUCUUCAAUGG | 3313 |
| CCAACCGAUGUUUUCUUCAA | 3314 |
| UCCAACCGAUGUUUUCUUCA | 3315 |
| AUCCAACCGAUGUUUUCUUC | 3316 |

TABLE 5-continued

| Sequence | SEQ ID NO: |
|---|---|
| UUCUUAUCCAUCCAACCGAU | 3317 |
| AUUCUUAUCCAUCCAACCGA | 3318 |
| CAGCCACACUCUGAUUUUAU | 3319 |
| UCACUUUGCAGCCACACUCU | 3320 |
| UUCACUUUGCAGCCACACUC | 3321 |
| CUUUUCACUUUGCAGCCACA | 3322 |
| GCUUUUCACUUUGCAGCCAC | 3323 |
| UUCAGGAUCAUGUUCAAGCU | 3324 |
| CUUCAGGAUCAUGUUCAAGC | 3325 |
| GCUUCAGGAUCAUGUUCAAG | 3326 |
| CAGCUUCAGGAUCAUGUUCA | 3327 |
| UCAGCUUCAGGAUCAUGUUC | 3328 |
| GUCAGCUUCAGGAUCAUGUU | 3329 |
| GCGUCAGCUUCAGGAUCAUG | 3330 |
| UGCGUCAGCUUCAGGAUCAU | 3331 |
| UUGCGUCAGCUUCAGGAUCA | 3332 |
| GUUGCGUCAGCUUCAGGAUC | 3333 |
| UGUUGCGUCAGCUUCAGGAU | 3334 |
| CUGUUGCGUCAGCUUCAGGA | 3335 |
| UCCUGUUGCGUCAGCUUCAG | 3336 |
| AUCCUGUUGCGUCAGCUUCA | 3337 |
| UCAUCCUGUUGCGUCAGCUU | 3338 |
| UUCAUCCUGUUGCGUCAGCU | 3339 |
| UUUCAUCCUGUUGCGUCAGC | 3340 |
| UUUUCAUCCUGUUGCGUCAG | 3341 |
| AUUUUCAUCCUGUUGCGUCA | 3342 |
| CAUUCCGUUUGAUGUAGCAU | 3343 |
| UUGCUAGAUGGAGAUGAAGU | 3344 |
| UUUGCUAGAUGGAGAUGAAG | 3345 |
| CAUUUGCUAGAUGGAGAUGA | 3346 |
| UCAUUUGCUAGAUGGAGAUG | 3347 |
| GCCUCAUUUGCUAGAUGGAG | 3348 |
| UGCCUCAUUUGCUAGAUGGA | 3349 |
| GUGCCUCAUUUGCUAGAUGG | 3350 |
| AGAACAGUGCCUCAUUUGCU | 3351 |
| GAGAACAGUGCCUCAUUUGC | 3352 |
| UUGGUUGAGAACAGUGCCUC | 3353 |
| UUUGGUUGAGAACAGUGCCU | 3354 |
| CUUUGGUUGAGAACAGUGCC | 3355 |

TABLE 5-continued

| Sequence | SEQ ID NO: |
|---|---|
| GACCACAGCACAUCAAAUUA | 3356 |
| CAAGGAGACCACAGCACAUC | 3357 |
| CCAAGGAGACCACAGCACAU | 3358 |
| ACCAAGGAGACCACAGCACA | 3359 |
| UUACCAAGGAGACCACAGCA | 3360 |
| CAUUACCAAGGAGACCACAG | 3361 |
| ACAUUACCAAGGAGACCACA | 3362 |
| UACAUUACCAAGGAGACCAC | 3363 |
| AUACAUUACCAAGGAGACCA | 3364 |
| CACCUGUGCAAUACCAAAUU | 3365 |
| UCACCUGUGCAAUACCAAAU | 3366 |
| AUCACCUGUGCAAUACCAAA | 3367 |
| AAUCACCUGUGCAAUACCAA | 3368 |
| ACUAAUCACCUGUGCAAUAC | 3369 |
| GACUAAUCACCUGUGCAAUA | 3370 |
| UGACUAAUCACCUGUGCAAU | 3371 |
| UUGACUAAUCACCUGUGCAA | 3372 |
| CCUUGACUAAUCACCUGUGC | 3373 |
| UCCUUGACUAAUCACCUGUG | 3374 |
| UUCCUUGACUAAUCACCUGU | 3375 |
| CUUCCUUGACUAAUCACCUG | 3376 |
| ACUUCCUUGACUAAUCACCU | 3377 |
| GACUUCCUUGACUAAUCACC | 3378 |
| AGACUUCCUUGACUAAUCAC | 3379 |
| CAGACUUCCUUGACUAAUCA | 3380 |
| AAGGCUGUGGGACCAAAGCU | 3381 |
| GCAAGGCUGUGGGACCAAAG | 3382 |
| GGCAAGGCUGUGGGACCAAA | 3383 |
| UGCUGUGAGGCAAGGCUGUG | 3384 |
| CAUGCUGUGAGGCAAGGCUG | 3385 |
| ACAUGCUGUGAGGCAAGGCU | 3386 |
| UUUACAUGCUGUGAGGCAAG | 3387 |
| AUUUACAUGCUGUGAGGCAA | 3388 |
| GAAGAACCUCAGCAUCAAUA | 3389 |
| AGAAGAACCUCAGCAUCAAU | 3390 |
| UAGAAGAACCUCAGCAUCAA | 3391 |
| CAGUAGAAGAACCUCAGCAU | 3392 |
| CUAGCAGUAGAAGAACCUCA | 3393 |
| ACUAGCAGUAGAAGAACCUC | 3394 |

TABLE 5-continued

| Sequence | SEQ ID NO: |
|---|---|
| GUCACUUUCAUACUAGCAGU | 3395 |
| CCCAAUUCACACCAGUAAAA | 3396 |
| UCCCAAUUCACACCAGUAAA | 3397 |
| CUUCCCAAUUCACACCAGUA | 3398 |
| CGUCAUGGAAUAGCAUUGUU | 3399 |
| ACGUCAUGGAAUAGCAUUGU | 3400 |
| CAAACGUCAUGGAAUAGCAU | 3401 |
| ACAAACGUCAUGGAAUAGCA | 3402 |
| UACAAACGUCAUGGAAUAGC | 3403 |
| CACAUAGUCAAGGACCUUAA | 3404 |
| ACACAUAGUCAAGGACCUUA | 3405 |
| UACACAUAGUCAAGGACCUU | 3406 |
| GUACACAUAGUCAAGGACCU | 3407 |
| CGAGAUGGCAGAGAUUAACU | 3408 |
| GCGAGAUGGCAGAGAUUAAC | 3409 |
| AUUUAGCGAGAUGGCAGAGA | 3410 |
| GAUUUAGCGAGAUGGCAGAG | 3411 |
| UGAUUUAGCGAGAUGGCAGA | 3412 |
| AUGAUUUAGCGAGAUGGCAG | 3413 |
| GAUGAUUUAGCGAGAUGGCA | 3414 |
| UGAUGAUUUAGCGAGAUGGC | 3415 |
| CUGAUGAUUUAGCGAGAUGG | 3416 |
| ACUGAUGAUUUAGCGAGAUG | 3417 |
| GACUGAUGAUUUAGCGAGAU | 3418 |
| AGACUGAUGAUUUAGCGAGA | 3419 |
| GAUCAGGCACCUUCUAUUUC | 3420 |
| AGAUCAGGCACCUUCUAUUU | 3421 |
| UUAGGAAGAUCAGGCACCUU | 3422 |
| AUUAGGAAGAUCAGGCACCU | 3423 |
| UAUUAGGAAGAUCAGGCACC | 3424 |
| GCAGCACAUCUUAUUUGGGA | 3425 |
| AGCAGCACAUCUUAUUUGGG | 3426 |
| AAGCAGCACAUCUUAUUUGG | 3427 |
| CUCGGUAAGCAGCACAUCUU | 3428 |
| CCUCGGUAAGCAGCACAUCU | 3429 |
| ACCUCGGUAAGCAGCACAUC | 3430 |
| UACCUCGGUAAGCAGCACAU | 3431 |
| AUACCUCGGUAAGCAGCACA | 3432 |
| GAUACCUCGGUAAGCAGCAC | 3433 |

TABLE 5-continued

| Sequence | SEQ ID NO: |
|---|---|
| UGAUACCUCGGUAAGCAGCA | 3434 |
| GUGAUACCUCGGUAAGCAGC | 3435 |
| CGUGAUACCUCGGUAAGCAG | 3436 |
| CCGUGAUACCUCGGUAAGCA | 3437 |
| CCCGUGAUACCUCGGUAAGC | 3438 |
| UCAACGACCCAAGCUGGAGC | 3439 |
| UUCAACGACCCAAGCUGGAG | 3440 |
| CUUCAACGACCCAAGCUGGA | 3441 |
| CCCAGCUUCAACGACCCAAG | 3442 |
| UCUCUGAAGUGGUUUCCCAA | 3443 |
| AUCUCUGAAGUGGUUUCCCA | 3444 |
| CAUCUCUGAAGUGGUUUCCC | 3445 |
| GAUGGCAUUGUGCUCAUAAU | 3446 |
| UGAUGGCAUUGUGCUCAUAA | 3447 |
| GUGAUGGCAUUGUGCUCAUA | 3448 |
| GUUAAGUGAUGGCAUUGUGC | 3449 |
| AGUUAAGUGAUGGCAUUGUG | 3450 |
| GAGUCUAUUUGGUCAAGAGA | 3451 |
| UGAGUCUAUUUGGUCAAGAG | 3452 |
| CCAUAACUCACUCACUAGAA | 3453 |
| AGCACCAUAACUCACUCACU | 3454 |
| CCAGCACCAUAACUCACUCA | 3455 |
| GCCAGCACCAUAACUCACUC | 3456 |
| AGCCAGCACCAUAACUCACU | 3457 |
| UAGCCAGCACCAUAACUCAC | 3458 |
| AUAGCCAGCACCAUAACUCA | 3459 |
| UAUAGCCAGCACCAUAACUC | 3460 |
| AAUAUAGCCAGCACCAUAAC | 3461 |
| CAAAAUAUAGCCAGCACCAU | 3462 |
| GCAAAAUAUAGCCAGCACCA | 3463 |
| GCAACAUUUGAGAGGGCAGU | 3464 |
| AGCAACAUUUGAGAGGGCAG | 3465 |
| UAGCAACAUUUGAGAGGGCA | 3466 |
| CUAGCAACAUUUGAGAGGGC | 3467 |
| CCUAGCAACAUUUGAGAGGG | 3468 |
| UCCUAGCAACAUUUGAGAGG | 3469 |
| UUCCUAGCAACAUUUGAGAG | 3470 |
| AAAUUCUGGCAAGCAAGGCC | 3471 |
| UCAAAUUCUGGCAAGCAAGG | 3472 |

TABLE 5-continued

| Sequence | SEQ ID NO: |
|---|---|
| AGUCAAAUUCUGGCAAGCAA | 3473 |
| AAGUCAAAUUCUGGCAAGCA | 3474 |
| AAAGUCAAAUUCUGGCAAGC | 3475 |
| CUGAAACCUGACACCGUAUA | 3476 |
| CCUGAAACCUGACACCGUAU | 3477 |
| CCCUGAAACCUGACACCGUA | 3478 |
| ACCCUGAAACCUGACACCGU | 3479 |
| CACCAAAGAGUUCUGGACUU | 3480 |
| UCACCAAAGAGUUCUGGACU | 3481 |
| GUCACCAAAGAGUUCUGGAC | 3482 |
| AGUCACCAAAGAGUUCUGGA | 3483 |
| AAAACGGCUUUACAGGGUAU | 3484 |
| GACCAUAGGUUGUUUCAUAC | 3485 |
| CAGACCAUAGGUUGUUUCAU | 3486 |

TABLE 5-continued

| Sequence | SEQ ID NO: |
|---|---|
| CCAGACCAUAGGUUGUUUCA | 3487 |
| UCCAGACCAUAGGUUGUUUC | 3488 |
| UUCCAGACCAUAGGUUGUUU | 3489 |
| UUUCCAGACCAUAGGUUGUU | 3490 |
| AUUUCCAGACCAUAGGUUGU | 3491 |
| AAUUUCCAGACCAUAGGUUG | 3492 |
| CACAUAUAGCUUUGCGAUAC | 3493 |
| GCACAUAUAGCUUUGCGAUA | 3494 |
| UGCACAUAUAGCUUUGCGAU | 3495 |
| AUGCACAUAUAGCUUUGCGA | 3496 |
| UAUGCACAUAUAGCUUUGCG | 3497 |
| GCAAACUCAAAGCAUAGAUC | 3498 |

In some embodiments, the siRNA molecules targeted to ERAP1 comprise or consist of the nucleotide sequences (sense and antisense strands) shown in Table 6.

TABLE 6

| Sense Sequence | SEQ ID NO: | Antisense Sequence | SEQ ID NO: |
|---|---|---|---|
| AAAGGCGUGCACUUCCUAC | 3499 | GUAGGAAGUGCACGCCUUU | 3500 |
| AAGGCGUGCACUUCCUACG | 3501 | CGUAGGAAGUGCACGCCUU | 3502 |
| CGUGCACUUCCUACGCCUG | 3503 | CAGGCGUAGGAAGUGCACG | 3504 |
| GUGCACUUCCUACGCCUGA | 3505 | UCAGGCGUAGGAAGUGCAC | 3506 |
| UGCACUUCCUACGCCUGAU | 3507 | AUCAGGCGUAGGAAGUGCA | 3508 |
| UCGCAACCUCGCAGCUUCC | 3509 | GGAAGCUGCGAGGUUGCGA | 3510 |
| CGGCGUGCAGCGCUCAUUU | 3511 | AAAUGAGCGCUGCACGCCG | 3512 |
| GGCGUGCAGCGCUCAUUUA | 3513 | UAAAUGAGCGCUGCACGCC | 3514 |
| GCGUGCAGCGCUCAUUUAC | 3515 | GUAAAUGAGCGCUGCACGC | 3516 |
| CGUGCAGCGCUCAUUUACC | 3517 | GGUAAAUGAGCGCUGCACG | 3518 |
| GUGCAGCGCUCAUUUACCA | 3519 | UGGUAAAUGAGCGCUGCAC | 3520 |
| UGCAGCGCUCAUUUACCAA | 3521 | UUGGUAAAUGAGCGCUGCA | 3522 |
| GCAGCGCUCAUUUACCAAU | 3523 | AUUGGUAAAUGAGCGCUGC | 3524 |
| CAGCGCUCAUUUACCAAUU | 3525 | AAUUGGUAAAUGAGCGCUG | 3526 |
| GCUCAUUUACCAAUUCCCU | 3527 | AGGGAAUUGGUAAAUGAGC | 3528 |
| CUCAUUUACCAAUUCCCUU | 3529 | AAGGGAAUUGGUAAAUGAG | 3530 |
| UCAUUUACCAAUUCCCUUC | 3531 | GAAGGGAAUUGGUAAAUGA | 3532 |
| CAUUUACCAAUUCCCUUCC | 3533 | GGAAGGGAAUUGGUAAAUG | 3534 |
| AUUUACCAAUUCCCUUCCU | 3535 | AGGAAGGGAAUUGGUAAAU | 3536 |
| CUUCCUGGGAGUUGCGGCU | 3537 | AGCCGCAACUCCCAGGAAG | 3538 |
| UUCCUGGGAGUUGCGGCUU | 3539 | AAGCCGCAACUCCCAGGAA | 3540 |
| UCCUGGGAGUUGCGGCUUC | 3541 | GAAGCCGCAACUCCCAGGA | 3542 |

TABLE 6-continued

| Sense Sequence | SEQ ID NO: | Antisense Sequence | SEQ ID NO: |
|---|---|---|---|
| CCCACUCCCGUUUACCCUU | 3543 | AAGGGUAAACGGGAGUGGG | 3544 |
| CCACUCCCGUUUACCCUUU | 3545 | AAAGGGUAAACGGGAGUGG | 3546 |
| GCUCCACUUUCACUUUCGG | 3547 | CCGAAAGUGAAAGUGGAGC | 3548 |
| CUCCACUUUCACUUUCGGU | 3549 | ACCGAAAGUGAAAGUGGAG | 3550 |
| ACUUUCACUUUCGGUCCUG | 3551 | CAGGACCGAAAGUGAAAGU | 3552 |
| CCCAGGUAGGUAGAGCAAG | 3553 | CUUGCUCUACCUACCUGGG | 3554 |
| CCAGGUAGGUAGAGCAAGA | 3555 | UCUUGCUCUACCUACCUGG | 3556 |
| CAGGUAGGUAGAGCAAGAA | 3557 | UUCUUGCUCUACCUACCUG | 3558 |
| AGGUAGGUAGAGCAAGAAG | 3559 | CUUCUUGCUCUACCUACCU | 3560 |
| GGUAGAGCAAGAAGAUGGU | 3561 | ACCAUCUUCUUGCUCUACC | 3562 |
| GUAGAGCAAGAAGAUGGUG | 3563 | CACCAUCUUCUUGCUCUAC | 3564 |
| UAGAGCAAGAAGAUGGUGU | 3565 | ACACCAUCUUCUUGCUCUA | 3566 |
| AGAGCAAGAAGAUGGUGUU | 3567 | AACACCAUCUUCUUGCUCU | 3568 |
| GAGCAAGAAGAUGGUGUUU | 3569 | AAACACCAUCUUCUUGCUC | 3570 |
| GAAGAUGGUGUUUCUGCCC | 3571 | GGGCAGAAACACCAUCUUC | 3572 |
| UCACUGUUGGCUCUCUUAA | 3573 | UUAAGAGAGCCAACAGUGA | 3574 |
| CACUGUUGGCUCUCUUAAC | 3575 | GUUAAGAGAGCCAACAGUG | 3576 |
| ACUGUUGGCUCUCUUAACU | 3577 | AGUUAAGAGAGCCAACAGU | 3578 |
| GGCUCUCUUAACUGUGUCC | 3579 | GGACACAGUUAAGAGAGCC | 3580 |
| GCUCUCUUAACUGUGUCCA | 3581 | UGGACACAGUUAAGAGAGC | 3582 |
| UAACUGUGUCCACUCCUUC | 3583 | GAAGGAGUGGACACAGUUA | 3584 |
| AACUGUGUCCACUCCUUCA | 3585 | UGAAGGAGUGGACACAGUU | 3586 |
| ACUGUGUCCACUCCUUCAU | 3587 | AUGAAGGAGUGGACACAGU | 3588 |
| UGUGUCCACUCCUUCAUGG | 3589 | CCAUGAAGGAGUGGACACA | 3590 |
| GUGUCCACUCCUUCAUGGU | 3591 | ACCAUGAAGGAGUGGACAC | 3592 |
| UGUCCACUCCUUCAUGGUG | 3593 | CACCAUGAAGGAGUGGACA | 3594 |
| GUCCACUCCUUCAUGGUGU | 3595 | ACACCAUGAAGGAGUGGAC | 3596 |
| UCCACUCCUUCAUGGUGUC | 3597 | GACACCAUGAAGGAGUGGA | 3598 |
| CCACUCCUUCAUGGUGUCA | 3599 | UGACACCAUGAAGGAGUGG | 3600 |
| CACUCCUUCAUGGUGUCAG | 3601 | CUGACACCAUGAAGGAGUG | 3602 |
| ACUCCUUCAUGGUGUCAGA | 3603 | UCUGACACCAUGAAGGAGU | 3604 |
| AGCACUGAAGCAUCUCCAA | 3605 | UUGGAGAUGCUUCAGUGCU | 3606 |
| GCACUGAAGCAUCUCCAAA | 3607 | UUUGGAGAUGCUUCAGUGC | 3608 |
| CACUGAAGCAUCUCCAAAA | 3609 | UUUUGGAGAUGCUUCAGUG | 3610 |
| AACGUAGUGAUGGGACACC | 3611 | GGUGUCCCAUCACUACGUU | 3612 |
| ACGUAGUGAUGGGACACCA | 3613 | UGGUGUCCCAUCACUACGU | 3614 |
| GGACACCAUUUCCUUGGAA | 3615 | UUCCAAGGAAAUGGGUUCC | 3616 |
| GACACCAUUUCCUUGGAAU | 3617 | AUUCCAAGGAAAUGGGUGUC | 3618 |
| ACACCAUUUCCUUGGAAUA | 3619 | UAUUCCAAGGAAAUGGUGU | 3620 |

TABLE 6-continued

| Sense Sequence | SEQ ID NO: | Antisense Sequence | SEQ ID NO: |
|---|---|---|---|
| CACCAUUUCCUUGGAAUAA | 3621 | UUAUUCCAAGGAAAUGGUG | 3622 |
| CCAUUUCCUUGGAAUAAAA | 3623 | UUUUAUUCCAAGGAAAUGG | 3624 |
| UUCCUUGGAAUAAAAUACG | 3625 | CGUAUUUUAUUCCAAGGAA | 3626 |
| UCCUUGGAAUAAAAUACGA | 3627 | UCGUAUUUUAUUCCAAGGA | 3628 |
| CCUUGGAAUAAAAUACGAC | 3629 | GUCGUAUUUUAUUCCAAGG | 3630 |
| UGGAAUAAAAUACGACUUC | 3631 | GAAGUCGUAUUUUAUUCCA | 3632 |
| GAAUAAAAUACGACUUCCU | 3633 | AGGAAGUCGUAUUUUAUUC | 3634 |
| GUCAUCCCAGUUCAUUAUG | 3635 | CAUAAUGAACUGGGAUGAC | 3636 |
| CCCAGUUCAUUAUGAUCUC | 3637 | GAGAUCAUAAUGAACUGGG | 3638 |
| CCAGUUCAUUAUGAUCUCU | 3639 | AGAGAUCAUAAUGAACUGG | 3640 |
| CAGUUCAUUAUGAUCUCUU | 3641 | AAGAGAUCAUAAUGAACUG | 3642 |
| UACCACGCUGACCUUCUGG | 3643 | CCAGAAGGUCAGCGUGGUA | 3644 |
| ACCACGCUGACCUUCUGGG | 3645 | CCCAGAAGGUCAGCGUGGU | 3646 |
| AAUCACAGCCAGUCAGCCC | 3647 | GGGCUGACUGGCUGUGAUU | 3648 |
| AUCACAGCCAGUCAGCCCA | 3649 | UGGGCUGACUGGCUGUGAU | 3650 |
| CACCAGCACCAUCAUCCUG | 3651 | CAGGAUGAUGGUGCUGGUG | 3652 |
| ACCAGCACCAUCAUCCUGC | 3653 | GCAGGAUGAUGGUGCUGGU | 3654 |
| CCAGCACCAUCAUCCUGCA | 3655 | UGCAGGAUGAUGGUGCUGG | 3656 |
| CAGCACCAUCAUCCUGCAU | 3657 | AUGCAGGAUGAUGGUGCUG | 3658 |
| AGCACCAUCAUCCUGCAUA | 3659 | UAUGCAGGAUGAUGGUGCU | 3660 |
| GCACCAUCAUCCUGCAUAG | 3661 | CUAUGCAGGAUGAUGGUGC | 3662 |
| CACCAUCAUCCUGCAUAGU | 3663 | ACUAUGCAGGAUGAUGGUG | 3664 |
| ACCAUCAUCCUGCAUAGUC | 3665 | GACUAUGCAGGAUGAUGGU | 3666 |
| CCAUCAUCCUGCAUAGUCA | 3667 | UGACUAUGCAGGAUGAUGG | 3668 |
| CAUCCUGCAUAGUCACCAC | 3669 | GUGGUGACUAUGCAGGAUG | 3670 |
| UAGUCACCACCUGCAGAUA | 3671 | UAUCUGCAGGUGGUGACUA | 3672 |
| AGUCACCACCUGCAGAUAU | 3673 | AUAUCUGCAGGUGGUGACU | 3674 |
| ACCACCUGCAGAUAUCUAG | 3675 | CUAGAUAUCUGCAGGUGGU | 3676 |
| CCACCUGCAGAUAUCUAGG | 3677 | CCUAGAUAUCUGCAGGUGG | 3678 |
| CACCUGCAGAUAUCUAGGG | 3679 | CCCUAGAUAUCUGCAGGUG | 3680 |
| ACCUGCAGAUAUCUAGGGC | 3681 | GCCCUAGAUAUCUGCAGGU | 3682 |
| CCUGCAGAUAUCUAGGGCC | 3683 | GGCCCUAGAUAUCUGCAGG | 3684 |
| CAAAUUGCACUGCUGGCUC | 3685 | GAGCCAGCAGUGCAAUUUG | 3686 |
| UCCUUGUCGGGCUCCCGUA | 3687 | UACGGGAGCCCGACAAGGA | 3688 |
| CUUGUCGGGCUCCCGUACA | 3689 | UGUACGGGAGCCCGACAAG | 3690 |
| CACAGUUGUCAUUCACUAU | 3691 | AUAGUGAAUGACAACUGUG | 3692 |
| ACAGUUGUCAUUCACUAUG | 3693 | CAUAGUGAAUGACAACUGU | 3694 |
| CAGUUGUCAUUCACUAUGC | 3695 | GCAUAGUGAAUGACAACUG | 3696 |
| AGUUGUCAUUCACUAUGCU | 3697 | AGCAUAGUGAAUGACAACU | 3698 |

TABLE 6-continued

| Sense Sequence | SEQ ID NO: | Antisense Sequence | SEQ ID NO: |
|---|---|---|---|
| GUUGUCAUUCACUAUGCUG | 3699 | CAGCAUAGUGAAUGACAAC | 3700 |
| CAUUCACUAUGCUGGCAAU | 3701 | AUUGCCAGCAUAGUGAAUG | 3702 |
| AUUCACUAUGCUGGCAAUC | 3703 | GAUUGCCAGCAUAGUGAAU | 3704 |
| UUCACUAUGCUGGCAAUCU | 3705 | AGAUUGCCAGCAUAGUGAA | 3706 |
| UCACUAUGCUGGCAAUCUU | 3707 | AAGAUUGCCAGCAUAGUGA | 3708 |
| CACUAUGCUGGCAAUCUUU | 3709 | AAAGAUUGCCAGCAUAGUG | 3710 |
| ACUAUGCUGGCAAUCUUUC | 3711 | GAAAGAUUGCCAGCAUAGU | 3712 |
| AGACUUUCCACGGAUUUUA | 3713 | UAAAAUCCGUGGAAAGUCU | 3714 |
| GACUUUCCACGGAUUUUAC | 3715 | GUAAAAUCCGUGGAAAGUC | 3716 |
| ACUUUCCACGGAUUUUACA | 3717 | UGUAAAAUCCGUGGAAAGU | 3718 |
| AACUGAGGAUACUAGCAUC | 3719 | GAUGCUAGUAUCCUCAGUU | 3720 |
| ACUGAGGAUACUAGCAUCA | 3721 | UGAUGCUAGUAUCCUCAGU | 3722 |
| CUGAGGAUACUAGCAUCAA | 3723 | UUGAUGCUAGUAUCCUCAG | 3724 |
| UGAGGAUACUAGCAUCAAC | 3725 | GUUGAUGCUAGUAUCCUCA | 3726 |
| UGCAGCUAGAAUGGCCUUU | 3727 | AAAGGCCAUUCUAGCUGCA | 3728 |
| AAUGGCCUUUCCCUGCUUU | 3729 | AAAGCAGGGAAAGGCCAUU | 3730 |
| GCCUUUCCCUGCUUUGAUG | 3731 | CAUCAAAGCAGGGAAAGGC | 3732 |
| CUUUCCCUGCUUUGAUGAA | 3733 | UUCAUCAAAGCAGGGAAAG | 3734 |
| ACCUGCCUUCAAAGCAAGU | 3735 | ACUUGCUUUGAAGGCAGGU | 3736 |
| CUGCCUUCAAAGCAAGUUU | 3737 | AAACUUGCUUUGAAGGCAG | 3738 |
| UGCCUUCAAAGCAAGUUUC | 3739 | GAAACUUGCUUUGAAGGCA | 3740 |
| GCCUUCAAAGCAAGUUUCU | 3741 | AGAAACUUGCUUUGAAGGC | 3742 |
| CAAAGCAAGUUUCUCAAUC | 3743 | GAUUGAGAAACUUGCUUUG | 3744 |
| AAGCAAGUUUCUCAAUCAA | 3745 | UUGAUUGAGAAACUUGCUU | 3746 |
| AGCAAGUUUCUCAAUCAAA | 3747 | UUUGAUUGAGAAACUUGCU | 3748 |
| GCAAGUUUCUCAAUCAAAA | 3749 | UUUUGAUUGAGAAACUUGC | 3750 |
| GAGCCAAGGCACCUAGCCA | 3751 | UGGCUAGGUGCCUUGGCUC | 3752 |
| GGCACCUAGCCAUCUCCAA | 3753 | UUGGAGAUGGCUAGGUGCC | 3754 |
| GCACCUAGCCAUCUCCAAU | 3755 | AUUGGAGAUGGCUAGGUGC | 3756 |
| CACCUAGCCAUCUCCAAUA | 3757 | UAUUGGAGAUGGCUAGGUG | 3758 |
| ACCUAGCCAUCUCCAAUAU | 3759 | AUAUUGGAGAUGGCUAGGU | 3760 |
| CCUAGCCAUCUCCAAUAUG | 3761 | CAUAUUGGAGAUGGCUAGG | 3762 |
| CUAGCCAUCUCCAAUAUGC | 3763 | GCAUAUUGGAGAUGGCUAG | 3764 |
| UAGCCAUCUCCAAUAUGCC | 3765 | GGCAUAUUGGAGAUGGCUA | 3766 |
| AGCCAUCUCCAAUAUGCCA | 3767 | UGGCAUAUUGGAGAUGGCU | 3768 |
| AAAUCUGUGACUGUUGCUG | 3769 | CAGCAACAGUCACAGAUUU | 3770 |
| AAUCUGUGACUGUUGCUGA | 3771 | UCAGCAACAGUCACAGAUU | 3772 |
| AUCUGUGACUGUUGCUGAA | 3773 | UUCAGCAACAGUCACAGAU | 3774 |
| UCUGUGACUGUUGCUGAAG | 3775 | CUUCAGCAACAGUCACAGA | 3776 |

TABLE 6-continued

| Sense Sequence | SEQ ID NO: | Antisense Sequence | SEQ ID NO: |
|---|---|---|---|
| UGACUGUUGCUGAAGGACU | 3777 | AGUCCUUCAGCAACAGUCA | 3778 |
| ACUGUUGCUGAAGGACUCA | 3779 | UGAGUCCUUCAGCAACAGU | 3780 |
| CUGUUGCUGAAGGACUCAU | 3781 | AUGAGUCCUUCAGCAACAG | 3782 |
| UGUUGCUGAAGGACUCAUA | 3783 | UAUGAGUCCUUCAGCAACA | 3784 |
| GUUGCUGAAGGACUCAUAG | 3785 | CUAUGAGUCCUUCAGCAAC | 3786 |
| UUGCUGAAGGACUCAUAGA | 3787 | UCUAUGAGUCCUUCAGCAA | 3788 |
| UGCUGAAGGACUCAUAGAA | 3789 | UUCUAUGAGUCCUUCAGCA | 3790 |
| GCUGAAGGACUCAUAGAAG | 3791 | CUUCUAUGAGUCCUUCAGC | 3792 |
| CUGAAGGACUCAUAGAAGA | 3793 | UCUUCUAUGAGUCCUUCAG | 3794 |
| UGAAGGACUCAUAGAAGAC | 3795 | GUCUUCUAUGAGUCCUUCA | 3796 |
| AAGGACUCAUAGAAGACCA | 3797 | UGGUCUUCUAUGAGUCCUU | 3798 |
| AGGACUCAUAGAAGACCAU | 3799 | AUGGUCUUCUAUGAGUCCU | 3800 |
| GGACUCAUAGAAGACCAUU | 3801 | AAUGGUCUUCUAUGAGUCC | 3802 |
| GACUCAUAGAAGACCAUUU | 3803 | AAAUGGUCUUCUAUGAGUC | 3804 |
| ACUCAUAGAAGACCAUUUU | 3805 | AAAAUGGUCUUCUAUGAGU | 3806 |
| CUCAUAGAAGACCAUUUUG | 3807 | CAAAAUGGUCUUCUAUGAG | 3808 |
| UCAUAGAAGACCAUUUUGA | 3809 | UCAAAAUGGUCUUCUAUGA | 3810 |
| CAUAGAAGACCAUUUUGAU | 3811 | AUCAAAAUGGUCUUCUAUG | 3812 |
| AUAGAAGACCAUUUUGAUG | 3813 | CAUCAAAAUGGUCUUCUAU | 3814 |
| UAGAAGACCAUUUUGAUGU | 3815 | ACAUCAAAAUGGUCUUCUA | 3816 |
| AGAAGACCAUUUUGAUGUC | 3817 | GACAUCAAAAUGGUCUUCU | 3818 |
| UGAUGUCACUGUGAAGAUG | 3819 | CAUCUUCACAGUGACAUCA | 3820 |
| GAUGUCACUGUGAAGAUGA | 3821 | UCAUCUUCACAGUGACAUC | 3822 |
| AUGUCACUGUGAAGAUGAG | 3823 | CUCAUCUUCACAGUGACAU | 3824 |
| UGUGAAGAUGAGCACCUAU | 3825 | AUAGGUGCUCAUCUUCACA | 3826 |
| GUGAAGAUGAGCACCUAUC | 3827 | GAUAGGUGCUCAUCUUCAC | 3828 |
| ACCUAUCUGGUGGCCUUCA | 3829 | UGAAGGCCACCAGAUAGGU | 3830 |
| CCUAUCUGGUGGCCUUCAU | 3831 | AUGAAGGCCACCAGAUAGG | 3832 |
| CUAUCUGGUGGCCUUCAUC | 3833 | GAUGAAGGCCACCAGAUAG | 3834 |
| UAUCUGGUGGCCUUCAUCA | 3835 | UGAUGAAGGCCACCAGAUA | 3836 |
| AUCUGGUGGCCUUCAUCAU | 3837 | AUGAUGAAGGCCACCAGAU | 3838 |
| UCUGGUGGCCUUCAUCAUU | 3839 | AAUGAUGAAGGCCACCAGA | 3840 |
| CUGGUGGCCUUCAUCAUUU | 3841 | AAAUGAUGAAGGCCACCAG | 3842 |
| UGGUGGCCUUCAUCAUUUC | 3843 | GAAAUGAUGAAGGCCACCA | 3844 |
| GGCCUUCAUCAUUUCAGAU | 3845 | AUCUGAAAUGAUGAAGGCC | 3846 |
| GCCUUCAUCAUUUCAGAUU | 3847 | AAUCUGAAAUGAUGAAGGC | 3848 |
| CCUUCAUCAUUUCAGAUUU | 3849 | AAAUCUGAAAUGAUGAAGG | 3850 |
| AGAUUUUGAGUCUGUCAGC | 3851 | GCUGACAGACUCAAAAUCU | 3852 |
| UUUGAGUCUGUCAGCAAGA | 3853 | UCUUGCUGACAGACUCAAA | 3854 |

TABLE 6-continued

| Sense Sequence | SEQ ID NO: | Antisense Sequence | SEQ ID NO: |
|---|---|---|---|
| UUGAGUCUGUCAGCAAGAU | 3855 | AUCUUGCUGACAGACUCAA | 3856 |
| UGAGUCUGUCAGCAAGAUA | 3857 | UAUCUUGCUGACAGACUCA | 3858 |
| GAGUCUGUCAGCAAGAUAA | 3859 | UUAUCUUGCUGACAGACUC | 3860 |
| AGUCUGUCAGCAAGAUAAC | 3861 | GUUAUCUUGCUGACAGACU | 3862 |
| GUCUGUCAGCAAGAUAACC | 3863 | GGUUAUCUUGCUGACAGAC | 3864 |
| UCUGUCAGCAAGAUAACCA | 3865 | UGGUUAUCUUGCUGACAGA | 3866 |
| UGUCAGCAAGAUAACCAAG | 3867 | CUUGGUUAUCUUGCUGACA | 3868 |
| GUCAGCAAGAUAACCAAGA | 3869 | UCUUGGUUAUCUUGCUGAC | 3870 |
| UCAGCAAGAUAACCAAGAG | 3871 | CUCUUGGUUAUCUUGCUGA | 3872 |
| CAGCAAGAUAACCAAGAGU | 3873 | ACUCUUGGUUAUCUUGCUG | 3874 |
| AGCAAGAUAACCAAGAGUG | 3875 | CACUCUUGGUUAUCUUGCU | 3876 |
| GCAAGAUAACCAAGAGUGG | 3877 | CCACUCUUGGUUAUCUUGC | 3878 |
| CAAGAUAACCAAGAGUGGA | 3879 | UCCACUCUUGGUUAUCUUG | 3880 |
| AAGAUAACCAAGAGUGGAG | 3881 | CUCCACUCUUGGUUAUCUU | 3882 |
| UAACCAAGAGUGGAGUCAA | 3883 | UUGACUCCACUCUUGGUUA | 3884 |
| AACCAAGAGUGGAGUCAAG | 3885 | CUUGACUCCACUCUUGGUU | 3886 |
| ACCAAGAGUGGAGUCAAGG | 3887 | CCUUGACUCCACUCUUGGU | 3888 |
| CCAAGAGUGGAGUCAAGGU | 3889 | ACCUUGACUCCACUCUUGG | 3890 |
| CAAGAGUGGAGUCAAGGUU | 3891 | AACCUUGACUCCACUCUUG | 3892 |
| AAGAGUGGAGUCAAGGUUU | 3893 | AAACCUUGACUCCACUCUU | 3894 |
| AGAGUGGAGUCAAGGUUUC | 3895 | GAAACCUUGACUCCACUCU | 3896 |
| GAGUGGAGUCAAGGUUUCU | 3897 | AGAAACCUUGACUCCACUC | 3898 |
| AGUGGAGUCAAGGUUUCUG | 3899 | CAGAAACCUUGACUCCACU | 3900 |
| GUGGAGUCAAGGUUUCUGU | 3901 | ACAGAAACCUUGACUCCAC | 3902 |
| UGGAGUCAAGGUUUCUGUU | 3903 | AACAGAAACCUUGACUCCA | 3904 |
| GGAGUCAAGGUUUCUGUUU | 3905 | AAACAGAAACCUUGACUCC | 3906 |
| GAGUCAAGGUUUCUGUUUA | 3907 | UAAACAGAAACCUUGACUC | 3908 |
| AGUCAAGGUUUCUGUUUAU | 3909 | AUAAACAGAAACCUUGACU | 3910 |
| GUCAAGGUUUCUGUUUAUG | 3911 | CAUAAACAGAAACCUUGAC | 3912 |
| UCAAGGUUUCUGUUUAUGC | 3913 | GCAUAAACAGAAACCUUGA | 3914 |
| CAAGGUUUCUGUUUAUGCU | 3915 | AGCAUAAACAGAAACCUUG | 3916 |
| AAGGUUUCUGUUUAUGCUG | 3917 | CAGCAUAAACAGAAACCUU | 3918 |
| AGGUUUCUGUUUAUGCUGU | 3919 | ACAGCAUAAACAGAAACCU | 3920 |
| UUUCUGUUUAUGCUGUGCC | 3921 | GGCACAGCAUAAACAGAAA | 3922 |
| UUCUGUUUAUGCUGUGCCA | 3923 | UGGCACAGCAUAAACAGAA | 3924 |
| CUGUUUAUGCUGUGCCAGA | 3925 | UCUGGCACAGCAUAAACAG | 3926 |
| UGUUUAUGCUGUGCCAGAC | 3927 | GUCUGGCACAGCAUAAACA | 3928 |
| GUUUAUGCUGUGCCAGACA | 3929 | UGUCUGGCACAGCAUAAAC | 3930 |
| AUGCACUGGAUGCUGCGGU | 3931 | ACCGCAGCAUCCAGUGCAU | 3932 |

TABLE 6-continued

| Sense Sequence | SEQ ID NO: | Antisense Sequence | SEQ ID NO: |
|---|---|---|---|
| UGCACUGGAUGCUGCGGUG | 3933 | CACCGCAGCAUCCAGUGCA | 3934 |
| GCACUGGAUGCUGCGGUGA | 3935 | UCACCGCAGCAUCCAGUGC | 3936 |
| CACUGGAUGCUGCGGUGAC | 3937 | GUCACCGCAGCAUCCAGUG | 3938 |
| ACUGGAUGCUGCGGUGACU | 3939 | AGUCACCGCAGCAUCCAGU | 3940 |
| CUGGAUGCUGCGGUGACUC | 3941 | GAGUCACCGCAGCAUCCAG | 3942 |
| UGGAUGCUGCGGUGACUCU | 3943 | AGAGUCACCGCAGCAUCCA | 3944 |
| GGAUGCUGCGGUGACUCUU | 3945 | AAGAGUCACCGCAGCAUCC | 3946 |
| GAUGCUGCGGUGACUCUUC | 3947 | GAAGAGUCACCGCAGCAUC | 3948 |
| AUGCUGCGGUGACUCUUCU | 3949 | AGAAGAGUCACCGCAGCAU | 3950 |
| UGCUGCGGUGACUCUUCUA | 3951 | UAGAAGAGUCACCGCAGCA | 3952 |
| GCUGCGGUGACUCUUCUAG | 3953 | CUAGAAGAGUCACCGCAGC | 3954 |
| CUGCGGUGACUCUUCUAGA | 3955 | UCUAGAAGAGUCACCGCAG | 3956 |
| UGCGGUGACUCUUCUAGAA | 3957 | UUCUAGAAGAGUCACCGCA | 3958 |
| GCGGUGACUCUUCUAGAAU | 3959 | AUUCUAGAAGAGUCACCGC | 3960 |
| CGGUGACUCUUCUAGAAUU | 3961 | AAUUCUAGAAGAGUCACCG | 3962 |
| CUUCUAGAAUUUUAUGAGG | 3963 | CCUCAUAAAAUUCUAGAAG | 3964 |
| CAAGAUCUUGCUGCUAUUC | 3965 | GAAUAGCAGCAAGAUCUUG | 3966 |
| AAGAUCUUGCUGCUAUUCC | 3967 | GGAAUAGCAGCAAGAUCUU | 3968 |
| AGAUCUUGCUGCUAUUCCC | 3969 | GGGAAUAGCAGCAAGAUCU | 3970 |
| GAUCUUGCUGCUAUUCCCG | 3971 | CGGGAAUAGCAGCAAGAUC | 3972 |
| UUGCUGCUAUUCCCGACUU | 3973 | AAGUCGGGAAUAGCAGCAA | 3974 |
| UGCUGCUAUUCCCGACUUU | 3975 | AAAGUCGGGAAUAGCAGCA | 3976 |
| GCUGCUAUUCCCGACUUUC | 3977 | GAAAGUCGGGAAUAGCAGC | 3978 |
| CUUUCAGUCUGGUGCUAUG | 3979 | CAUAGCACCAGACUGAAAG | 3980 |
| UUUCAGUCUGGUGCUAUGG | 3981 | CCAUAGCACCAGACUGAAA | 3982 |
| UUCAGUCUGGUGCUAUGGA | 3983 | UCCAUAGCACCAGACUGAA | 3984 |
| UCAGUCUGGUGCUAUGGAA | 3985 | UUCCAUAGCACCAGACUGA | 3986 |
| AAUCUGCUCUGUUGUUUGA | 3987 | UCAAACAACAGAGCAGAUU | 3988 |
| AUCUGCUCUGUUGUUUGAU | 3989 | AUCAAACAACAGAGCAGAU | 3990 |
| UCUGCUCUGUUGUUUGAUG | 3991 | CAUCAAACAACAGAGCAGA | 3992 |
| CUGCUCUGUUGUUUGAUGC | 3993 | GCAUCAAACAACAGAGCAG | 3994 |
| AAAAGUCUUCUGCAUCAAG | 3995 | CUUGAUGCAGAAGACUUUU | 3996 |
| AAGUCUUCUGCAUCAAGUA | 3997 | UACUUGAUGCAGAAGACUU | 3998 |
| AGUCUUCUGCAUCAAGUAA | 3999 | UUACUUGAUGCAGAAGACU | 4000 |
| GUCUUCUGCAUCAAGUAAG | 4001 | CUUACUUGAUGCAGAAGAC | 4002 |
| UCUUCUGCAUCAAGUAAGC | 4003 | GCUUACUUGAUGCAGAAGA | 4004 |
| AACCUGGUCACUAUGGAAU | 4005 | AUUCCAUAGUGACCAGGUU | 4006 |
| ACCUGGUCACUAUGGAAUG | 4007 | CAUUCCAUAGUGACCAGGU | 4008 |
| CCUGGUCACUAUGGAAUGG | 4009 | CCAUUCCAUAGUGACCAGG | 4010 |

TABLE 6-continued

| Sense Sequence | SEQ ID NO: | Antisense Sequence | SEQ ID NO: |
|---|---|---|---|
| CUGGUCACUAUGGAAUGGU | 4011 | ACCAUUCCAUAGUGACCAG | 4012 |
| UGGUCACUAUGGAAUGGUG | 4013 | CACCAUUCCAUAGUGACCA | 4014 |
| GGUCACUAUGGAAUGGUGG | 4015 | CCACCAUUCCAUAGUGACC | 4016 |
| GUCACUAUGGAAUGGUGGA | 4017 | UCCACCAUUCCAUAGUGAC | 4018 |
| UCACUAUGGAAUGGUGGAA | 4019 | UUCCACCAUUCCAUAGUGA | 4020 |
| CACUAUGGAAUGGUGGAAU | 4021 | AUUCCACCAUUCCAUAGUG | 4022 |
| ACUAUGGAAUGGUGGAAUG | 4023 | CAUUCCACCAUUCCAUAGU | 4024 |
| UGGAAUGGUGGAAUGAUCU | 4025 | AGAUCAUUCCACCAUUCCA | 4026 |
| GGAAUGGUGGAAUGAUCUU | 4027 | AAGAUCAUUCCACCAUUCC | 4028 |
| GAAUGGUGGAAUGAUCUUU | 4029 | AAAGAUCAUUCCACCAUUC | 4030 |
| AAUGGUGGAAUGAUCUUUG | 4031 | CAAAGAUCAUUCCACCAUU | 4032 |
| AUGGUGGAAUGAUCUUUGG | 4033 | CCAAAGAUCAUUCCACCAU | 4034 |
| UGGUGGAAUGAUCUUUGGC | 4035 | GCCAAAGAUCAUUCCACCA | 4036 |
| GGUGGAAUGAUCUUUGGCU | 4037 | AGCCAAAGAUCAUUCCACC | 4038 |
| GUGGAAUGAUCUUUGGCUA | 4039 | UAGCCAAAGAUCAUUCCAC | 4040 |
| UGGAAUGAUCUUUGGCUAA | 4041 | UUAGCCAAAGAUCAUUCCA | 4042 |
| GGAAUGAUCUUUGGCUAAA | 4043 | UUUAGCCAAAGAUCAUUCC | 4044 |
| GAAUGAUCUUUGGCUAAAU | 4045 | AUUUAGCCAAAGAUCAUUC | 4046 |
| AAUGAUCUUUGGCUAAAUG | 4047 | CAUUUAGCCAAAGAUCAUU | 4048 |
| AAUUUAUGGAGUUUGUGUC | 4049 | GACACAAACUCCAUAAAUU | 4050 |
| AUUUAUGGAGUUUGUGUCU | 4051 | AGACACAAACUCCAUAAAU | 4052 |
| UUUAUGGAGUUUGUGUCUG | 4053 | CAGACACAAACUCCAUAAA | 4054 |
| UUAUGGAGUUUGUGUCUGU | 4055 | ACAGACACAAACUCCAUAA | 4056 |
| UAUGGAGUUUGUGUCUGUC | 4057 | GACAGACACAAACUCCAUA | 4058 |
| AUGGAGUUUGUGUCUGUCA | 4059 | UGACAGACACAAACUCCAU | 4060 |
| UGGAGUUUGUGUCUGUCAG | 4061 | CUGACAGACACAAACUCCA | 4062 |
| GGAGUUUGUGUCUGUCAGU | 4063 | ACUGACAGACACAAACUCC | 4064 |
| GAGUUUGUGUCUGUCAGUG | 4065 | CACUGACAGACACAAACUC | 4066 |
| AGUUUGUGUCUGUCAGUGU | 4067 | ACACUGACAGACACAAACU | 4068 |
| CAGUGUGACCCAUCCUGAA | 4069 | UUCAGGAUGGGUCACACUG | 4070 |
| GCAAUGGAGGUAGAUGCUU | 4071 | AAGCAUCUACCUCCAUUGC | 4072 |
| AGGUAGAUGCUUUAAAUUC | 4073 | GAAUUUAAAGCAUCUACCU | 4074 |
| GGUAGAUGCUUUAAAUUCC | 4075 | GGAAUUUAAAGCAUCUACC | 4076 |
| GUAGAUGCUUUAAAUUCCU | 4077 | AGGAAUUUAAAGCAUCUAC | 4078 |
| UAGAUGCUUUAAAUUCCUC | 4079 | GAGGAAUUUAAAGCAUCUA | 4080 |
| CCUGUGUCUACACCUGUGG | 4081 | CCACAGGUGUAGACACAGG | 4082 |
| UGUGUCUACACCUGUGGAA | 4083 | UUCCACAGGUGUAGACACA | 4084 |
| UAUGAUAAGGGAGCUUGUA | 4085 | UACAAGCUCCCUUAUCAUA | 4086 |
| AUAAGGGAGCUUGUAUUCU | 4087 | AGAAUACAAGCUCCCUUAU | 4088 |

TABLE 6-continued

| Sense Sequence | SEQ ID NO: | Antisense Sequence | SEQ ID NO: |
|---|---|---|---|
| UAAGGGAGCUUGUAUUCUG | 4089 | CAGAAUACAAGCUCCCUUA | 4090 |
| AAGGGAGCUUGUAUUCUGA | 4091 | UCAGAAUACAAGCUCCCUU | 4092 |
| AGGGAGCUUGUAUUCUGAA | 4093 | UUCAGAAUACAAGCUCCCU | 4094 |
| AUUCUGAAUAUGCUAAGGG | 4095 | CCCUUAGCAUAUUCAGAAU | 4096 |
| GAAUAUGCUAAGGGAGUAU | 4097 | AUACUCCCUUAGCAUAUUC | 4098 |
| AAUAUGCUAAGGGAGUAUC | 4099 | GAUACUCCCUUAGCAUAUU | 4100 |
| AUAUGCUAAGGGAGUAUCU | 4101 | AGAUACUCCCUUAGCAUAU | 4102 |
| UAUGCUAAGGGAGUAUCUU | 4103 | AAGAUACUCCCUUAGCAUA | 4104 |
| GCUGACGCAUUUAAAAGUG | 4105 | CACUUUUAAAUGCGUCAGC | 4106 |
| CUGACGCAUUUAAAAGUGG | 4107 | CCACUUUUAAAUGCGUCAG | 4108 |
| UGACGCAUUUAAAAGUGGU | 4109 | ACCACUUUUAAAUGCGUCA | 4110 |
| GACGCAUUUAAAAGUGGUA | 4111 | UACCACUUUUAAAUGCGUC | 4112 |
| ACGCAUUUAAAAGUGGUAU | 4113 | AUACCACUUUUAAAUGCGU | 4114 |
| CGCAUUUAAAAGUGGUAUU | 4115 | AAUACCACUUUUAAAUGCG | 4116 |
| GCAUUUAAAAGUGGUAUUG | 4117 | CAAUACCACUUUUAAAUGC | 4118 |
| AAAGUGGUAUUGUACAGUA | 4119 | UACUGUACAAUACCACUUU | 4120 |
| AAGUGGUAUUGUACAGUAU | 4121 | AUACUGUACAAUACCACUU | 4122 |
| AGUGGUAUUGUACAGUAUC | 4123 | GAUACUGUACAAUACCACU | 4124 |
| GUGGUAUUGUACAGUAUCU | 4125 | AGAUACUGUACAAUACCAC | 4126 |
| UGGUAUUGUACAGUAUCUC | 4127 | GAGAUACUGUACAAUACCA | 4128 |
| GGUAUUGUACAGUAUCUCC | 4129 | GGAGAUACUGUACAAUACC | 4130 |
| GUAUUGUACAGUAUCUCCA | 4131 | UGGAGAUACUGUACAAUAC | 4132 |
| UAUUGUACAGUAUCUCCAG | 4133 | CUGGAGAUACUGUACAAUA | 4134 |
| AUUGUACAGUAUCUCCAGA | 4135 | UCUGGAGAUACUGUACAAU | 4136 |
| UUGUACAGUAUCUCCAGAA | 4137 | UUCUGGAGAUACUGUACAA | 4138 |
| UGUACAGUAUCUCCAGAAG | 4139 | CUUCUGGAGAUACUGUACA | 4140 |
| CUCCAGAAGCAUAGCUAUA | 4141 | UAUAGCUAUGCUUCUGGAG | 4142 |
| UCCAGAAGCAUAGCUAUAA | 4143 | UUAUAGCUAUGCUUCUGGA | 4144 |
| CCAGAAGCAUAGCUAUAAA | 4145 | UUUAUAGCUAUGCUUCUGG | 4146 |
| ACGAGGACCUGUGGGAUAG | 4147 | CUAUCCCACAGGUCCUCGU | 4148 |
| CGAGGACCUGUGGGAUAGU | 4149 | ACUAUCCCACAGGUCCUCG | 4150 |
| GAGGACCUGUGGGAUAGUA | 4151 | UACUAUCCCACAGGUCCUC | 4152 |
| AGGACCUGUGGGAUAGUAU | 4153 | AUACUAUCCCACAGGUCCU | 4154 |
| GGACCUGUGGGAUAGUAUG | 4155 | CAUACUAUCCCACAGGUCC | 4156 |
| GACCUGUGGGAUAGUAUGG | 4157 | CCAUACUAUCCCACAGGUC | 4158 |
| ACCUGUGGGAUAGUAUGGC | 4159 | GCCAUACUAUCCCACAGGU | 4160 |
| CCUGUGGGAUAGUAUGGCA | 4161 | UGCCAUACUAUCCCACAGG | 4162 |
| CUGUGGGAUAGUAUGGCAA | 4163 | UUGCCAUACUAUCCCACAG | 4164 |
| UGUGGGAUAGUAUGGCAAG | 4165 | CUUGCCAUACUAUCCCACA | 4166 |

TABLE 6-continued

| Sense Sequence | SEQ ID NO: | Antisense Sequence | SEQ ID NO: |
|---|---|---|---|
| GUGGGAUAGUAUGGCAAGU | 4167 | ACUUGCCAUACUAUCCCAC | 4168 |
| UGGGAUAGUAUGGCAAGUA | 4169 | UACUUGCCAUACUAUCCCA | 4170 |
| GGGAUAGUAUGGCAAGUAU | 4171 | AUACUUGCCAUACUAUCCC | 4172 |
| AAGUAUUUGCCCUACAGAU | 4173 | AUCUGUAGGGCAAAUACUU | 4174 |
| AGUAUUUGCCCUACAGAUG | 4175 | CAUCUGUAGGGCAAAUACU | 4176 |
| GUAUUUGCCCUACAGAUGG | 4177 | CCAUCUGUAGGGCAAAUAC | 4178 |
| UAUUUGCCCUACAGAUGGU | 4179 | ACCAUCUGUAGGGCAAAUA | 4180 |
| AUUUGCCCUACAGAUGGUG | 4181 | CACCAUCUGUAGGGCAAAU | 4182 |
| UUUGCCCUACAGAUGGUGU | 4183 | ACACCAUCUGUAGGGCAAA | 4184 |
| UGGUGUAAAAGGGAUGGAU | 4185 | AUCCAUCCCUUUUACACCA | 4186 |
| GGUGUAAAAGGGAUGGAUG | 4187 | CAUCCAUCCCUUUUACACC | 4188 |
| GUGUAAAAGGGAUGGAUGG | 4189 | CCAUCCAUCCCUUUUACAC | 4190 |
| UGUAAAAGGGAUGGAUGGC | 4191 | GCCAUCCAUCCCUUUUACA | 4192 |
| AAGGGAUGGAUGGCUUUUG | 4193 | CAAAAGCCAUCCAUCCCUU | 4194 |
| AGGGAUGGAUGGCUUUUGC | 4195 | GCAAAAGCCAUCCAUCCCU | 4196 |
| GGGAUGGAUGGCUUUUGCU | 4197 | AGCAAAAGCCAUCCAUCCC | 4198 |
| GAUGGAUGGCUUUUGCUCU | 4199 | AGAGCAAAAGCCAUCCAUC | 4200 |
| AUGGAUGGCUUUUGCUCUA | 4201 | UAGAGCAAAAGCCAUCCAU | 4202 |
| UGGAUGGCUUUUGCUCUAG | 4203 | CUAGAGCAAAAGCCAUCCA | 4204 |
| GGAUGGCUUUUGCUCUAGA | 4205 | UCUAGAGCAAAAGCCAUCC | 4206 |
| GAUGGCUUUUGCUCUAGAA | 4207 | UUCUAGAGCAAAAGCCAUC | 4208 |
| AUGGCUUUUGCUCUAGAAG | 4209 | CUUCUAGAGCAAAAGCCAU | 4210 |
| UGGCUUUUGCUCUAGAAGU | 4211 | ACUUCUAGAGCAAAAGCCA | 4212 |
| GGCUUUUGCUCUAGAAGUC | 4213 | GACUUCUAGAGCAAAAGCC | 4214 |
| GCUUUUGCUCUAGAAGUCA | 4215 | UGACUUCUAGAGCAAAAGC | 4216 |
| CUUUUGCUCUAGAAGUCAA | 4217 | UUGACUUCUAGAGCAAAAG | 4218 |
| UUUUGCUCUAGAAGUCAAC | 4219 | GUUGACUUCUAGAGCAAAA | 4220 |
| UUCAUCUUCAUCCUCACAU | 4221 | AUGUGAGGAUGAAGAUGAA | 4222 |
| UCAUCUUCAUCCUCACAUU | 4223 | AAUGUGAGGAUGAAGAUGA | 4224 |
| CAUCUUCAUCCUCACAUUG | 4225 | CAAUGUGAGGAUGAAGAUG | 4226 |
| AUCUUCAUCCUCACAUUGG | 4227 | CCAAUGUGAGGAUGAAGAU | 4228 |
| UCUUCAUCCUCACAUUGGC | 4229 | GCCAAUGUGAGGAUGAAGA | 4230 |
| CUUCAUCCUCACAUUGGCA | 4231 | UGCCAAUGUGAGGAUGAAG | 4232 |
| UUCAUCCUCACAUUGGCAU | 4233 | AUGCCAAUGUGAGGAUGAA | 4234 |
| UCAUCCUCACAUUGGCAUC | 4235 | GAUGCCAAUGUGAGGAUGA | 4236 |
| CAUCCUCACAUUGGCAUCA | 4237 | UGAUGCCAAUGUGAGGAUG | 4238 |
| CCCUAAUAACCAUCACAGU | 4239 | ACUGUGAUGGUUAUUAGGG | 4240 |
| CCUAAUAACCAUCACAGUG | 4241 | CACUGUGAUGGUUAUUAGG | 4242 |
| AGCAAGAGCACUACAUGAA | 4243 | UUCAUGUAGUGCUCUUGCU | 4244 |

TABLE 6-continued

| Sense Sequence | SEQ ID NO: | Antisense Sequence | SEQ ID NO: |
|---|---|---|---|
| GCAAGAGCACUACAUGAAG | 4245 | CUUCAUGUAGUGCUCUUGC | 4246 |
| CACUACAUGAAGGGCUCUG | 4247 | CAGAGCCCUUCAUGUAGUG | 4248 |
| ACUACAUGAAGGGCUCUGA | 4249 | UCAGAGCCCUUCAUGUAGU | 4250 |
| CUACAUGAAGGGCUCUGAC | 4251 | GUCAGAGCCCUUCAUGUAG | 4252 |
| UACAUGAAGGGCUCUGACG | 4253 | CGUCAGAGCCCUUCAUGUA | 4254 |
| ACAUGAAGGGCUCUGACGG | 4255 | CCGUCAGAGCCCUUCAUGU | 4256 |
| CAUGAAGGGCUCUGACGGC | 4257 | GCCGUCAGAGCCCUUCAUG | 4258 |
| AUGAAGGGCUCUGACGGCG | 4259 | CGCCGUCAGAGCCCUUCAU | 4260 |
| CCGGACACUGGGUACCUGU | 4261 | ACAGGUACCCAGUGUCCGG | 4262 |
| CGGACACUGGGUACCUGUG | 4263 | CACAGGUACCCAGUGUCCG | 4264 |
| GGACACUGGGUACCUGUGG | 4265 | CCACAGGUACCCAGUGUCC | 4266 |
| GACACUGGGUACCUGUGGC | 4267 | GCCACAGGUACCCAGUGUC | 4268 |
| ACACUGGGUACCUGUGGCA | 4269 | UGCCACAGGUACCCAGUGU | 4270 |
| CACUGGGUACCUGUGGCAU | 4271 | AUGCCACAGGUACCCAGUG | 4272 |
| ACUGGGUACCUGUGGCAUG | 4273 | CAUGCCACAGGUACCCAGU | 4274 |
| CUGGGUACCUGUGGCAUGU | 4275 | ACAUGCCACAGGUACCCAG | 4276 |
| UGGGUACCUGUGGCAUGUU | 4277 | AACAUGCCACAGGUACCCA | 4278 |
| GGGUACCUGUGGCAUGUUC | 4279 | GAACAUGCCACAGGUACCC | 4280 |
| GGUACCUGUGGCAUGUUCC | 4281 | GGAACAUGCCACAGGUACC | 4282 |
| GUACCUGUGGCAUGUUCCA | 4283 | UGGAACAUGCCACAGGUAC | 4284 |
| UACCUGUGGCAUGUUCCAU | 4285 | AUGGAACAUGCCACAGGUA | 4286 |
| ACCUGUGGCAUGUUCCAUU | 4287 | AAUGGAACAUGCCACAGGU | 4288 |
| CCUGUGGCAUGUUCCAUUG | 4289 | CAAUGGAACAUGCCACAGG | 4290 |
| CUGUGGCAUGUUCCAUUGA | 4291 | UCAAUGGAACAUGCCACAG | 4292 |
| UGUGGCAUGUUCCAUUGAC | 4293 | GUCAAUGGAACAUGCCACA | 4294 |
| GUGGCAUGUUCCAUUGACA | 4295 | UGUCAAUGGAACAUGCCAC | 4296 |
| UGUUCCAUUGACAUUCAUC | 4297 | GAUGAAUGUCAAUGGAACA | 4298 |
| UCCAUUGACAUUCAUCACC | 4299 | GGUGAUGAAUGUCAAUGGA | 4300 |
| CAUUGACAUUCAUCACCAG | 4301 | CUGGUGAUGAAUGUCAAUG | 4302 |
| ACAUUCAUCACCAGCAAAU | 4303 | AUUUGCUGGUGAUGAAUGU | 4304 |
| CUCCCAGAAGAGGUGGAAU | 4305 | AUUCCACCUCUUCUGGGAG | 4306 |
| UCCCAGAAGAGGUGGAAUG | 4307 | CAUUCCACCUCUUCUGGGA | 4308 |
| CCCAGAAGAGGUGGAAUGG | 4309 | CCAUUCCACCUCUUCUGGG | 4310 |
| CCAGAAGAGGUGGAAUGGA | 4311 | UCCAUUCCACCUCUUCUGG | 4312 |
| CAGAAGAGGUGGAAUGGAU | 4313 | AUCCAUUCCACCUCUUCUG | 4314 |
| AGAAGAGGUGGAAUGGAUC | 4315 | GAUCCAUUCCACCUCUUCU | 4316 |
| GAAGAGGUGGAAUGGAUCA | 4317 | UGAUCCAUUCCACCUCUUC | 4318 |
| GAGGUGGAAUGGAUCAAAU | 4319 | AUUUGAUCCAUUCCACCUC | 4320 |
| AGGUGGAAUGGAUCAAAUU | 4321 | AAUUUGAUCCAUUCCACCU | 4322 |

TABLE 6-continued

| Sense Sequence | SEQ ID NO: | Antisense Sequence | SEQ ID NO: |
|---|---|---|---|
| GGUGGAAUGGAUCAAAUUU | 4323 | AAAUUUGAUCCAUUCCACC | 4324 |
| GUGGAAUGGAUCAAAUUUA | 4325 | UAAAUUUGAUCCAUUCCAC | 4326 |
| GAUCAAAUUUAAUGUGGGC | 4327 | GCCCACAUUAAAUUUGAUC | 4328 |
| AUCAAAUUUAAUGUGGGCA | 4329 | UGCCCACAUUAAAUUUGAU | 4330 |
| UCAAAUUUAAUGUGGGCAU | 4331 | AUGCCCACAUUAAAUUUGA | 4332 |
| CAAAUUUAAUGUGGGCAUG | 4333 | CAUGCCCACAUUAAAUUUG | 4334 |
| AAAUUUAAUGUGGGCAUGA | 4335 | UCAUGCCCACAUUAAAUUU | 4336 |
| AAUUUAAUGUGGGCAUGAA | 4337 | UUCAUGCCCACAUUAAAUU | 4338 |
| UAAUGUGGGCAUGAAUGGC | 4339 | GCCAUUCAUGCCCACAUUA | 4340 |
| AAUGUGGGCAUGAAUGGCU | 4341 | AGCCAUUCAUGCCCACAUU | 4342 |
| AUGUGGGCAUGAAUGGCUA | 4343 | UAGCCAUUCAUGCCCACAU | 4344 |
| UGUGGGCAUGAAUGGCUAU | 4345 | AUAGCCAUUCAUGCCCACA | 4346 |
| GUGGGCAUGAAUGGCUAUU | 4347 | AAUAGCCAUUCAUGCCCAC | 4348 |
| UGGGCAUGAAUGGCUAUUA | 4349 | UAAUAGCCAUUCAUGCCCA | 4350 |
| GGGCAUGAAUGGCUAUUAC | 4351 | GUAAUAGCCAUUCAUGCCC | 4352 |
| GGCAUGAAUGGCUAUUACA | 4353 | UGUAAUAGCCAUUCAUGCC | 4354 |
| AUGGCUAUUACAUUGUGCA | 4355 | UGCACAAUGUAAUAGCCAU | 4356 |
| AUUACAUUGUGCAUUACGA | 4357 | UCGUAAUGCACAAUGUAAU | 4358 |
| UUACAUUGUGCAUUACGAG | 4359 | CUCGUAAUGCACAAUGUAA | 4360 |
| UACAUUGUGCAUUACGAGG | 4361 | CCUCGUAAUGCACAAUGUA | 4362 |
| ACAUUGUGCAUUACGAGGA | 4363 | UCCUCGUAAUGCACAAUGU | 4364 |
| CAUUGUGCAUUACGAGGAU | 4365 | AUCCUCGUAAUGCACAAUG | 4366 |
| AUUGUGCAUUACGAGGAUG | 4367 | CAUCCUCGUAAUGCACAAU | 4368 |
| UUGUGCAUUACGAGGAUGA | 4369 | UCAUCCUCGUAAUGCACAA | 4370 |
| UGUGCAUUACGAGGAUGAU | 4371 | AUCAUCCUCGUAAUGCACA | 4372 |
| GUGCAUUACGAGGAUGAUG | 4373 | CAUCAUCCUCGUAAUGCAC | 4374 |
| UGCAUUACGAGGAUGAUGG | 4375 | CCAUCAUCCUCGUAAUGCA | 4376 |
| GCAUUACGAGGAUGAUGGA | 4377 | UCCAUCAUCCUCGUAAUGC | 4378 |
| CAUUACGAGGAUGAUGGAU | 4379 | AUCCAUCAUCCUCGUAAUG | 4380 |
| AUUACGAGGAUGAUGGAUG | 4381 | CAUCCAUCAUCCUCGUAAU | 4382 |
| UUACGAGGAUGAUGGAUGG | 4383 | CCAUCCAUCAUCCUCGUAA | 4384 |
| UACGAGGAUGAUGGAUGGG | 4385 | CCCAUCCAUCAUCCUCGUA | 4386 |
| ACGAGGAUGAUGGAUGGGA | 4387 | UCCCAUCCAUCAUCCUCGU | 4388 |
| CGAGGAUGAUGGAUGGGAC | 4389 | GUCCCAUCCAUCAUCCUCG | 4390 |
| GAGGAUGAUGGAUGGGACU | 4391 | AGUCCCAUCCAUCAUCCUC | 4392 |
| AGGAUGAUGGAUGGGACUC | 4393 | GAGUCCCAUCCAUCAUCCU | 4394 |
| GGAUGAUGGAUGGGACUCU | 4395 | AGAGUCCCAUCCAUCAUCC | 4396 |
| GAUGAUGGAUGGGACUCUU | 4397 | AAGAGUCCCAUCCAUCAUC | 4398 |
| AUGAUGGAUGGGACUCUUU | 4399 | AAAGAGUCCCAUCCAUCAU | 4400 |

TABLE 6-continued

| Sense Sequence | SEQ ID NO: | Antisense Sequence | SEQ ID NO: |
|---|---|---|---|
| UGAUGGAUGGGACUCUUUG | 4401 | CAAAGAGUCCCAUCCAUCA | 4402 |
| GAUGGAUGGGACUCUUUGA | 4403 | UCAAAGAGUCCCAUCCAUC | 4404 |
| AUGGAUGGGACUCUUUGAC | 4405 | GUCAAAGAGUCCCAUCCAU | 4406 |
| UGGAUGGGACUCUUUGACU | 4407 | AGUCAAAGAGUCCCAUCCA | 4408 |
| GGAUGGGACUCUUUGACUG | 4409 | CAGUCAAAGAGUCCCAUCC | 4410 |
| GAUGGGACUCUUUGACUGG | 4411 | CCAGUCAAAGAGUCCCAUC | 4412 |
| AUGGGACUCUUUGACUGGC | 4413 | GCCAGUCAAAGAGUCCCAU | 4414 |
| UGGGACUCUUUGACUGGCC | 4415 | GGCCAGUCAAAGAGUCCCA | 4416 |
| GGGACUCUUUGACUGGCCU | 4417 | AGGCCAGUCAAAGAGUCCC | 4418 |
| GGACUCUUUGACUGGCCUU | 4419 | AAGGCCAGUCAAAGAGUCC | 4420 |
| GACUCUUUGACUGGCCUUU | 4421 | AAAGGCCAGUCAAAGAGUC | 4422 |
| ACUCUUUGACUGGCCUUUU | 4423 | AAAAGGCCAGUCAAAGAGU | 4424 |
| CUCUUUGACUGGCCUUUUA | 4425 | UAAAAGGCCAGUCAAAGAG | 4426 |
| UCUUUGACUGGCCUUUUAA | 4427 | UUAAAAGGCCAGUCAAAGA | 4428 |
| CUUUGACUGGCCUUUUAAA | 4429 | UUUAAAAGGCCAGUCAAAG | 4430 |
| UUUGACUGGCCUUUUAAAA | 4431 | UUUUAAAAGGCCAGUCAAA | 4432 |
| UUGACUGGCCUUUUAAAAG | 4433 | CUUUUAAAAGGCCAGUCAA | 4434 |
| CACAGCAGUCAGCAGUAAU | 4435 | AUUACUGCUGACUGCUGUG | 4436 |
| ACAGCAGUCAGCAGUAAUG | 4437 | CAUUACUGCUGACUGCUGU | 4438 |
| CAGCAGUCAGCAGUAAUGA | 4439 | UCAUUACUGCUGACUGCUG | 4440 |
| AGCAGUCAGCAGUAAUGAU | 4441 | AUCAUUACUGCUGACUGCU | 4442 |
| GCAGUCAGCAGUAAUGAUC | 4443 | GAUCAUUACUGCUGACUGC | 4444 |
| CAGUCAGCAGUAAUGAUCG | 4445 | CGAUCAUUACUGCUGACUG | 4446 |
| AGUCAGCAGUAAUGAUCGG | 4447 | CCGAUCAUUACUGCUGACU | 4448 |
| GUCAGCAGUAAUGAUCGGG | 4449 | CCCGAUCAUUACUGCUGAC | 4450 |
| UCAGCAGUAAUGAUCGGGC | 4451 | GCCCGAUCAUUACUGCUGA | 4452 |
| AGCAUUGGGAAGCUGUCCA | 4453 | UGGACAGCUUCCCAAUGCU | 4454 |
| GCAUUGGGAAGCUGUCCAU | 4455 | AUGGACAGCUUCCCAAUGC | 4456 |
| CAUUGGGAAGCUGUCCAUU | 4457 | AAUGGACAGCUUCCCAAUG | 4458 |
| AUUGGGAAGCUGUCCAUUG | 4459 | CAAUGGACAGCUUCCCAAU | 4460 |
| UUGGGAAGCUGUCCAUUGA | 4461 | UCAAUGGACAGCUUCCCAA | 4462 |
| UGGGAAGCUGUCCAUUGAA | 4463 | UUCAAUGGACAGCUUCCCA | 4464 |
| AAAAGGCCUUGGAUUUAUC | 4465 | GAUAAAUCCAAGGCCUUUU | 4466 |
| AAAGGCCUUGGAUUUAUCC | 4467 | GGAUAAAUCCAAGGCCUUU | 4468 |
| AAGGCCUUGGAUUUAUCCC | 4469 | GGGAUAAAUCCAAGGCCUU | 4470 |
| CCUUGGAUUUAUCCCUGUA | 4471 | UACAGGGAUAAAUCCAAGG | 4472 |
| CUUGGAUUUAUCCCUGUAC | 4473 | GUACAGGGAUAAAUCCAAG | 4474 |
| UUGGAUUUAUCCCUGUACU | 4475 | AGUACAGGGAUAAAUCCAA | 4476 |
| UGGAUUUAUCCCUGUACUU | 4477 | AAGUACAGGGAUAAAUCCA | 4478 |

TABLE 6-continued

| Sense Sequence | SEQ ID NO: | Antisense Sequence | SEQ ID NO: |
|---|---|---|---|
| GGAUUUAUCCCUGUACUUG | 4479 | CAAGUACAGGGAUAAAUCC | 4480 |
| AUUAUGCCCGUGUUUCAAG | 4481 | CUUGAAACACGGGCAUAAU | 4482 |
| UUAUGCCCGUGUUUCAAGG | 4483 | CCUUGAAACACGGGCAUAA | 4484 |
| UAUGCCCGUGUUUCAAGGU | 4485 | ACCUUGAAACACGGGCAUA | 4486 |
| AUGCCCGUGUUUCAAGGUU | 4487 | AACCUUGAAACACGGGCAU | 4488 |
| UGCCCGUGUUUCAAGGUUU | 4489 | AAACCUUGAAACACGGGCA | 4490 |
| CAAGGUUUGAAUGAGCUGA | 4491 | UCAGCUCAUUCAAACCUUG | 4492 |
| CUGAUUCCUAUGUAUAAGU | 4493 | ACUUAUACAUAGGAAUCAG | 4494 |
| CCUAUGUAUAAGUUAAUGG | 4495 | CCAUUAACUUAUACAUAGG | 4496 |
| AACUCAAUUCAAGGCCUUC | 4497 | GAAGGCCUUGAAUUGAGUU | 4498 |
| ACUCAAUUCAAGGCCUUCC | 4499 | GGAAGGCCUUGAAUUGAGU | 4500 |
| CUCAAUUCAAGGCCUUCCU | 4501 | AGGAAGGCCUUGAAUUGAG | 4502 |
| UCAAUUCAAGGCCUUCCUC | 4503 | GAGGAAGGCCUUGAAUUGA | 4504 |
| UUCAAGGCCUUCCUCAUCA | 4505 | UGAUGAGGAAGGCCUUGAA | 4506 |
| UCCUCAUCAGGCUGCUAAG | 4507 | CUUAGCAGCCUGAUGAGGA | 4508 |
| CCUCAUCAGGCUGCUAAGG | 4509 | CCUUAGCAGCCUGAUGAGG | 4510 |
| UCAGGCUGCUAAGGGACCU | 4511 | AGGUCCCUUAGCAGCCUGA | 4512 |
| CAGGCUGCUAAGGGACCUC | 4513 | GAGGUCCCUUAGCAGCCUG | 4514 |
| AGGCUGCUAAGGGACCUCA | 4515 | UGAGGUCCCUUAGCAGCCU | 4516 |
| GGCUGCUAAGGGACCUCAU | 4517 | AUGAGGUCCCUUAGCAGCC | 4518 |
| GCUGCUAAGGGACCUCAUU | 4519 | AAUGAGGUCCCUUAGCAGC | 4520 |
| CUGCUAAGGGACCUCAUUG | 4521 | CAAUGAGGUCCCUUAGCAG | 4522 |
| UGCUAAGGGACCUCAUUGA | 4523 | UCAAUGAGGUCCCUUAGCA | 4524 |
| GCUAAGGGACCUCAUUGAU | 4525 | AUCAAUGAGGUCCCUUAGC | 4526 |
| CUAAGGGACCUCAUUGAUA | 4527 | UAUCAAUGAGGUCCCUUAG | 4528 |
| AAGGGACCUCAUUGAUAAG | 4529 | CUUAUCAAUGAGGUCCCUU | 4530 |
| AGGGACCUCAUUGAUAAGC | 4531 | GCUUAUCAAUGAGGUCCCU | 4532 |
| GGGACCUCAUUGAUAAGCA | 4533 | UGCUUAUCAAUGAGGUCCC | 4534 |
| GGACCUCAUUGAUAAGCAG | 4535 | CUGCUUAUCAAUGAGGUCC | 4536 |
| GACCUCAUUGAUAAGCAGA | 4537 | UCUGCUUAUCAAUGAGGUC | 4538 |
| AUUGAUAAGCAGACAUGGA | 4539 | UCCAUGUCUGCUUAUCAAU | 4540 |
| GAUAAGCAGACAUGGACAG | 4541 | CUGUCCAUGUCUGCUUAUC | 4542 |
| AUAAGCAGACAUGGACAGA | 4543 | UCUGUCCAUGUCUGCUUAU | 4544 |
| UAAGCAGACAUGGACAGAC | 4545 | GUCUGUCCAUGUCUGCUUA | 4546 |
| AGCAGACAUGGACAGACGA | 4547 | UCGUCUGUCCAUGUCUGCU | 4548 |
| GCAGACAUGGACAGACGAG | 4549 | CUCGUCUGUCCAUGUCUGC | 4550 |
| CAGACAUGGACAGACGAGG | 4551 | CCUCGUCUGUCCAUGUCUG | 4552 |
| AGACAUGGACAGACGAGGG | 4553 | CCCUCGUCUGUCCAUGUCU | 4554 |
| GACAUGGACAGACGAGGGC | 4555 | GCCCUCGUCUGUCCAUGUC | 4556 |

TABLE 6-continued

| Sense Sequence | SEQ ID NO: | Antisense Sequence | SEQ ID NO: |
|---|---|---|---|
| UGGACAGACGAGGGCUCAG | 4557 | CUGAGCCCUCGUCUGUCCA | 4558 |
| GACAGACGAGGGCUCAGUC | 4559 | GACUGAGCCCUCGUCUGUC | 4560 |
| GACGAGGGCUCAGUCUCAG | 4561 | CUGAGACUGAGCCCUCGUC | 4562 |
| ACGAGGGCUCAGUCUCAGA | 4563 | UCUGAGACUGAGCCCUCGU | 4564 |
| AACUACUACUCCUCGCCUG | 4565 | CAGGCGAGGAGUAGUAGUU | 4566 |
| ACUACUACUCCUCGCCUGU | 4567 | ACAGGCGAGGAGUAGUAGU | 4568 |
| CUACUACUCCUCGCCUGUG | 4569 | CACAGGCGAGGAGUAGUAG | 4570 |
| UACUACUCCUCGCCUGUGU | 4571 | ACACAGGCGAGGAGUAGUA | 4572 |
| ACUACUCCUCGCCUGUGUG | 4573 | CACACAGGCGAGGAGUAGU | 4574 |
| CUACUCCUCGCCUGUGUGC | 4575 | GCACACAGGCGAGGAGUAG | 4576 |
| UACUCCUCGCCUGUGUGCA | 4577 | UGCACACAGGCGAGGAGUA | 4578 |
| ACUCCUCGCCUGUGUGCAC | 4579 | GUGCACACAGGCGAGGAGU | 4580 |
| UACAGAGGGCAGAAGGCUA | 4581 | UAGCCUUCUGCCCUCUGUA | 4582 |
| ACAGAGGGCAGAAGGCUAU | 4583 | AUAGCCUUCUGCCCUCUGU | 4584 |
| AGAGGGCAGAAGGCUAUUU | 4585 | AAAUAGCCUUCUGCCCUCU | 4586 |
| GAGGGCAGAAGGCUAUUUC | 4587 | GAAAUAGCCUUCUGCCCUC | 4588 |
| GCAGAAGGCUAUUUCAGAA | 4589 | UUCUGAAAUAGCCUUCUGC | 4590 |
| CCUGUCGACGUGACCUUGG | 4591 | CCAAGGUCACGUCGACAGG | 4592 |
| CUGUCGACGUGACCUUGGC | 4593 | GCCAAGGUCACGUCGACAG | 4594 |
| UGUCGACGUGACCUUGGCA | 4595 | UGCCAAGGUCACGUCGACA | 4596 |
| GUCGACGUGACCUUGGCAG | 4597 | CUGCCAAGGUCACGUCGAC | 4598 |
| UCGACGUGACCUUGGCAGU | 4599 | ACUGCCAAGGUCACGUCGA | 4600 |
| UGACCUUGGCAGUGUUUGC | 4601 | GCAAACACUGCCAAGGUCA | 4602 |
| CCUUGGCAGUGUUUGCUGU | 4603 | ACAGCAAACACUGCCAAGG | 4604 |
| UUGGCAGUGUUUGCUGUGG | 4605 | CCACAGCAAACACUGCCAA | 4606 |
| UGGCAGUGUUUGCUGUGGG | 4607 | CCCACAGCAAACACUGCCA | 4608 |
| CAGAGCACAGAAGGCUGGG | 4609 | CCCAGCCUUCUGUGCUCUG | 4610 |
| AGAGCACAGAAGGCUGGGA | 4611 | UCCCAGCCUUCUGUGCUCU | 4612 |
| GAGCACAGAAGGCUGGGAU | 4613 | AUCCCAGCCUUCUGUGCUC | 4614 |
| AGCACAGAAGGCUGGGAUU | 4615 | AAUCCCAGCCUUCUGUGCU | 4616 |
| GCACAGAAGGCUGGGAUUU | 4617 | AAAUCCCAGCCUUCUGUGC | 4618 |
| ACAGAAGGCUGGGAUUUUC | 4619 | GAAAAUCCCAGCCUUCUGU | 4620 |
| AGUUUUCUUUGUCCAGUAC | 4621 | GUACUGGACAAAGAAAACU | 4622 |
| GUUUUCUUUGUCCAGUACU | 4623 | AGUACUGGACAAAGAAAAC | 4624 |
| UUUUCUUUGUCCAGUACUG | 4625 | CAGUACUGGACAAAGAAAA | 4626 |
| UUUCUUUGUCCAGUACUGA | 4627 | UCAGUACUGGACAAAGAAA | 4628 |
| UUCUUUGUCCAGUACUGAG | 4629 | CUCAGUACUGGACAAAGAA | 4630 |
| AAAAGCUUCAAUGGCUACU | 4631 | AGUAGCCAUUGAAGCUUUU | 4632 |
| AAAGCUUCAAUGGCUACUA | 4633 | UAGUAGCCAUUGAAGCUUU | 4634 |

TABLE 6-continued

| Sense Sequence | SEQ ID NO: | Antisense Sequence | SEQ ID NO: |
|---|---|---|---|
| CUUCAAUGGCUACUAGAUG | 4635 | CAUCUAGUAGCCAUUGAAG | 4636 |
| UUCAAUGGCUACUAGAUGA | 4637 | UCAUCUAGUAGCCAUUGAA | 4638 |
| UCAAUGGCUACUAGAUGAA | 4639 | UUCAUCUAGUAGCCAUUGA | 4640 |
| CAAAUUCUUACACUCAUUG | 4641 | CAAUGAGUGUAAGAAUUUG | 4642 |
| AAAUUCUUACACUCAUUGG | 4643 | CCAAUGAGUGUAAGAAUUU | 4644 |
| AAUUCUUACACUCAUUGGC | 4645 | GCCAAUGAGUGUAAGAAUU | 4646 |
| AUUCUUACACUCAUUGGCA | 4647 | UGCCAAUGAGUGUAAGAAU | 4648 |
| UUCUUACACUCAUUGGCAG | 4649 | CUGCCAAUGAGUGUAAGAA | 4650 |
| UCUUACACUCAUUGGCAGG | 4651 | CCUGCCAAUGAGUGUAAGA | 4652 |
| CUUACACUCAUUGGCAGGA | 4653 | UCCUGCCAAUGAGUGUAAG | 4654 |
| UUACACUCAUUGGCAGGAA | 4655 | UUCCUGCCAAUGAGUGUAA | 4656 |
| UGGCCUGGCAAUUUCUGAG | 4657 | CUCAGAAAUUGCCAGGCCA | 4658 |
| GGCCUGGCAAUUUCUGAGG | 4659 | CCUCAGAAAUUGCCAGGCC | 4660 |
| GCCUGGCAAUUUCUGAGGA | 4661 | UCCUCAGAAAUUGCCAGGC | 4662 |
| ACUUGGCUCAUCUUCCAUA | 4663 | UAUGGAAGAUGAGCCAAGU | 4664 |
| CUUGGCUCAUCUUCCAUAG | 4665 | CUAUGGAAGAUGAGCCAAG | 4666 |
| GCUCAUCUUCCAUAGCCCA | 4667 | UGGGCUAUGGAAGAUGAGC | 4668 |
| CUCAUCUUCCAUAGCCCAC | 4669 | GUGGGCUAUGGAAGAUGAG | 4670 |
| CAUAGCCCACAUGGUAAUG | 4671 | CAUUACCAUGUGGGCUAUG | 4672 |
| AUAGCCCACAUGGUAAUGG | 4673 | CCAUUACCAUGUGGGCUAU | 4674 |
| CCACAUGGUAAUGGGUACA | 4675 | UGUACCCAUUACCAUGUGG | 4676 |
| ACACGGCUUGAAGAGGUAA | 4677 | UUACCUCUUCAAGCCGUGU | 4678 |
| CACGGCUUGAAGAGGUAAA | 4679 | UUUACCUCUUCAAGCCGUG | 4680 |
| ACGGCUUGAAGAGGUAAAA | 4681 | UUUUACCUCUUCAAGCCGU | 4682 |
| CGGCUUGAAGAGGUAAAAG | 4683 | CUUUUACCUCUUCAAGCCG | 4684 |
| GGCUUGAAGAGGUAAAAGG | 4685 | CCUUUUACCUCUUCAAGCC | 4686 |
| GCUUGAAGAGGUAAAAGGA | 4687 | UCCUUUUACCUCUUCAAGC | 4688 |
| GAAGAGGUAAAAGGAUUCU | 4689 | AGAAUCCUUUUACCUCUUC | 4690 |
| AGAGGUAAAAGGAUUCUUC | 4691 | GAAGAAUCCUUUUACCUCU | 4692 |
| GUAAAAGGAUUCUUCAGCU | 4693 | AGCUGAAGAAUCCUUUUAC | 4694 |
| UAAAAGGAUUCUUCAGCUC | 4695 | GAGCUGAAGAAUCCUUUUA | 4696 |
| AAAAGGAUUCUUCAGCUCU | 4697 | AGAGCUGAAGAAUCCUUUU | 4698 |
| AAAGGAUUCUUCAGCUCUU | 4699 | AAGAGCUGAAGAAUCCUUU | 4700 |
| AAGGAUUCUUCAGCUCUUU | 4701 | AAAGAGCUGAAGAAUCCUU | 4702 |
| AGGAUUCUUCAGCUCUUUG | 4703 | CAAAGAGCUGAAGAAUCCU | 4704 |
| GGAUUCUUCAGCUCUUUGA | 4705 | UCAAAGAGCUGAAGAAUCC | 4706 |
| AAAAUGGUUCUCAGCUCCG | 4707 | CGGAGCUGAGAACCAUUUU | 4708 |
| AAAUGGUUCUCAGCUCCGU | 4709 | ACGGAGCUGAGAACCAUUU | 4710 |
| GGUUCUCAGCUCCGUUGUG | 4711 | CACAACGGAGCUGAGAACC | 4712 |

TABLE 6-continued

| Sense Sequence | SEQ ID NO: | Antisense Sequence | SEQ ID NO: |
|---|---|---|---|
| GUUCUCAGCUCCGUUGUGU | 4713 | ACACAACGGAGCUGAGAAC | 4714 |
| UUCUCAGCUCCGUUGUGUC | 4715 | GACACAACGGAGCUGAGAA | 4716 |
| UCUCAGCUCCGUUGUGUCC | 4717 | GGACACAACGGAGCUGAGA | 4718 |
| CUCAGCUCCGUUGUGUCCA | 4719 | UGGACACAACGGAGCUGAG | 4720 |
| UCAGCUCCGUUGUGUCCAA | 4721 | UUGGACACAACGGAGCUGA | 4722 |
| AUCGGUUGGAUGGAUAAGA | 4723 | UCUUAUCCAUCCAACCGAU | 4724 |
| UCGGUUGGAUGGAUAAGAA | 4725 | UUCUUAUCCAUCCAACCGA | 4726 |
| CGGUUGGAUGGAUAAGAAU | 4727 | AUUCUUAUCCAUCCAACCG | 4728 |
| GGUUGGAUGGAUAAGAAUU | 4729 | AAUUCUUAUCCAUCCAACC | 4730 |
| GGAUGGAUAAGAAUUUUGA | 4731 | UCAAAAUUCUUAUCCAUCC | 4732 |
| GAUAAAAUCAGAGUGUGGC | 4733 | GCCACACUCUGAUUUUAUC | 4734 |
| UAAAAUCAGAGUGUGGCUG | 4735 | CAGCCACACUCUGAUUUUA | 4736 |
| AAAAUCAGAGUGUGGCUGC | 4737 | GCAGCCACACUCUGAUUUU | 4738 |
| AAAUCAGAGUGUGGCUGCA | 4739 | UGCAGCCACACUCUGAUUU | 4740 |
| AAUCAGAGUGUGGCUGCAA | 4741 | UUGCAGCCACACUCUGAUU | 4742 |
| UCAGAGUGUGGCUGCAAAG | 4743 | CUUUGCAGCCACACUCUGA | 4744 |
| CAGAGUGUGGCUGCAAAGU | 4745 | ACUUUGCAGCCACACUCUG | 4746 |
| AGAGUGUGGCUGCAAAGUG | 4747 | CACUUUGCAGCCACACUCU | 4748 |
| GAGUGUGGCUGCAAAGUGA | 4749 | UCACUUUGCAGCCACACUC | 4750 |
| AGUGUGGCUGCAAAGUGAA | 4751 | UUCACUUUGCAGCCACACU | 4752 |
| ACAUGAUCCUGAAGCUGAC | 4753 | GUCAGCUUCAGGAUCAUGU | 4754 |
| CAUGAUCCUGAAGCUGACG | 4755 | CGUCAGCUUCAGGAUCAUG | 4756 |
| AUGAUCCUGAAGCUGACGC | 4757 | GCGUCAGCUUCAGGAUCAU | 4758 |
| UGAUCCUGAAGCUGACGCA | 4759 | UGCGUCAGCUUCAGGAUCA | 4760 |
| GAUCCUGAAGCUGACGCAA | 4761 | UUGCGUCAGCUUCAGGAUC | 4762 |
| AUCCUGAAGCUGACGCAAC | 4763 | GUUGCGUCAGCUUCAGGAU | 4764 |
| AAAAUCCAUCAGAAUCUCA | 4765 | UGAGAUUCUGAUGGAUUUU | 4766 |
| CACUAAAUAUGCUUUGAUG | 4767 | CAUCAAAGCAUAUUUAGUG | 4768 |
| ACUAAAUAUGCUUUGAUGC | 4769 | GCAUCAAAGCAUAUUUAGU | 4770 |
| CUAAAUAUGCUUUGAUGCU | 4771 | AGCAUCAAAGCAUAUUUAG | 4772 |
| AAAUAUGCUUUGAUGCUAC | 4773 | GUAGCAUCAAAGCAUAUUU | 4774 |
| AAUAUGCUUUGAUGCUACA | 4775 | UGUAGCAUCAAAGCAUAUU | 4776 |
| CUUCGCUAAAGUUACUUCA | 4777 | UGAAGUAACUUUAGCGAAG | 4778 |
| UUCGCUAAAGUUACUUCAU | 4779 | AUGAAGUAACUUUAGCGAA | 4780 |
| UCGCUAAAGUUACUUCAUC | 4781 | GAUGAAGUAACUUUAGCGA | 4782 |
| CGCUAAAGUUACUUCAUCU | 4783 | AGAUGAAGUAACUUUAGCG | 4784 |
| UACUUCAUCUCCAUCUAGC | 4785 | GCUAGAUGGAGAUGAAGUA | 4786 |
| ACUUCAUCUCCAUCUAGCA | 4787 | UGCUAGAUGGAGAUGAAGU | 4788 |
| CUUCAUCUCCAUCUAGCAA | 4789 | UUGCUAGAUGGAGAUGAAG | 4790 |

TABLE 6-continued

| Sense Sequence | SEQ ID NO: | Antisense Sequence | SEQ ID NO: |
|---|---|---|---|
| UUCAUCUCCAUCUAGCAAA | 4791 | UUUGCUAGAUGGAGAUGAA | 4792 |
| UCAUCUCCAUCUAGCAAAU | 4793 | AUUUGCUAGAUGGAGAUGA | 4794 |
| CAUCUCCAUCUAGCAAAUG | 4795 | CAUUUGCUAGAUGGAGAUG | 4796 |
| UCCAUCUAGCAAAUGAGGC | 4797 | GCCUCAUUUGCUAGAUGGA | 4798 |
| CCAUCUAGCAAAUGAGGCA | 4799 | UGCCUCAUUUGCUAGAUGG | 4800 |
| CAUCUAGCAAAUGAGGCAC | 4801 | GUGCCUCAUUUGCUAGAUG | 4802 |
| GGCACUGUUCUCAACCAAA | 4803 | UUUGGUUGAGAACAGUGCC | 4804 |
| CUGUUCUCAACCAAAGGAG | 4805 | CUCCUUUGGUUGAGAACAG | 4806 |
| CCCUUUAUAAUUUGAUGUG | 4807 | CACAUCAAAUUAUAAAGGG | 4808 |
| CCUUUAUAAUUUGAUGUGC | 4809 | GCACAUCAAAUUAUAAAGG | 4810 |
| AUAAUUUGAUGUGCUGUGG | 4811 | CCACAGCACAUCAAAUUAU | 4812 |
| UUUGAUGUGCUGUGGUCUC | 4813 | GAGACCACAGCACAUCAAA | 4814 |
| AUGUGCUGUGGUCUCCUUG | 4815 | CAAGGAGACCACAGCACAU | 4816 |
| UGUGCUGUGGUCUCCUUGG | 4817 | CCAAGGAGACCACAGCACA | 4818 |
| GUGCUGUGGUCUCCUUGGU | 4819 | ACCAAGGAGACCACAGCAC | 4820 |
| UGCUGUGGUCUCCUUGGUA | 4821 | UACCAAGGAGACCACAGCA | 4822 |
| GCUGUGGUCUCCUUGGUAA | 4823 | UUACCAAGGAGACCACAGC | 4824 |
| CUGUGGUCUCCUUGGUAAU | 4825 | AUUACCAAGGAGACCACAG | 4826 |
| UGUGGUCUCCUUGGUAAUG | 4827 | CAUUACCAAGGAGACCACA | 4828 |
| UAAUUUGGUAUUGCACAGG | 4829 | CCUGUGCAAUACCAAAUUA | 4830 |
| AAUUUGGUAUUGCACAGGU | 4831 | ACCUGUGCAAUACCAAAUU | 4832 |
| AUUUGGUAUUGCACAGGUG | 4833 | CACCUGUGCAAUACCAAAU | 4834 |
| UUUGGUAUUGCACAGGUGA | 4835 | UCACCUGUGCAAUACCAAA | 4836 |
| UUGGUAUUGCACAGGUGAU | 4837 | AUCACCUGUGCAAUACCAA | 4838 |
| UGGUAUUGCACAGGUGAUU | 4839 | AAUCACCUGUGCAAUACCA | 4840 |
| GGUAUUGCACAGGUGAUUA | 4841 | UAAUCACCUGUGCAAUACC | 4842 |
| GUAUUGCACAGGUGAUUAG | 4843 | CUAAUCACCUGUGCAAUAC | 4844 |
| UAUUGCACAGGUGAUUAGU | 4845 | ACUAAUCACCUGUGCAAUA | 4846 |
| AUUGCACAGGUGAUUAGUC | 4847 | GACUAAUCACCUGUGCAAU | 4848 |
| UUGCACAGGUGAUUAGUCA | 4849 | UGACUAAUCACCUGUGCAA | 4850 |
| UGCACAGGUGAUUAGUCAA | 4851 | UUGACUAAUCACCUGUGCA | 4852 |
| GCACAGGUGAUUAGUCAAG | 4853 | CUUGACUAAUCACCUGUGC | 4854 |
| CACAGGUGAUUAGUCAAGG | 4855 | CCUUGACUAAUCACCUGUG | 4856 |
| ACAGGUGAUUAGUCAAGGA | 4857 | UCCUUGACUAAUCACCUGU | 4858 |
| CAGGUGAUUAGUCAAGGAA | 4859 | UUCCUUGACUAAUCACCUG | 4860 |
| AGGUGAUUAGUCAAGGAAG | 4861 | CUUCCUUGACUAAUCACCU | 4862 |
| GGUGAUUAGUCAAGGAAGU | 4863 | ACUUCCUUGACUAAUCACC | 4864 |
| GUGAUUAGUCAAGGAAGUC | 4865 | GACUUCCUUGACUAAUCAC | 4866 |
| UGAUUAGUCAAGGAAGUCU | 4867 | AGACUUCCUUGACUAAUCA | 4868 |

143
144

TABLE 6-continued

| Sense Sequence | SEQ ID NO: | Antisense Sequence | SEQ ID NO: |
|---|---|---|---|
| GAUUAGUCAAGGAAGUCUG | 4869 | CAGACUUCCUUGACUAAUC | 4870 |
| UUAGUCAAGGAAGUCUGGA | 4871 | UCCAGACUUCCUUGACUAA | 4872 |
| UAGUCAAGGAAGUCUGGAA | 4873 | UUCCAGACUUCCUUGACUA | 4874 |
| CCCACAGCCUUGCCUCACA | 4875 | UGUGAGGCAAGGCUGUGGG | 4876 |
| CCACAGCCUUGCCUCACAG | 4877 | CUGUGAGGCAAGGCUGUGG | 4878 |
| CACAGCCUUGCCUCACAGC | 4879 | GCUGUGAGGCAAGGCUGUG | 4880 |
| ACAGCCUUGCCUCACAGCA | 4881 | UGCUGUGAGGCAAGGCUGU | 4882 |
| CAGCCUUGCCUCACAGCAU | 4883 | AUGCUGUGAGGCAAGGCUG | 4884 |
| AGCCUUGCCUCACAGCAUG | 4885 | CAUGCUGUGAGGCAAGGCU | 4886 |
| GCCUUGCCUCACAGCAUGU | 4887 | ACAUGCUGUGAGGCAAGGC | 4888 |
| CCUUGCCUCACAGCAUGUA | 4889 | UACAUGCUGUGAGGCAAGG | 4890 |
| CUUGCCUCACAGCAUGUAA | 4891 | UUACAUGCUGUGAGGCAAG | 4892 |
| UUGCCUCACAGCAUGUAAA | 4893 | UUUACAUGCUGUGAGGCAA | 4894 |
| UGCCUCACAGCAUGUAAAU | 4895 | AUUUACAUGCUGUGAGGCA | 4896 |
| GCCUCACAGCAUGUAAAUA | 4897 | UAUUUACAUGCUGUGAGGC | 4898 |
| CCUCACAGCAUGUAAAUAA | 4899 | UUAUUUACAUGCUGUGAGG | 4900 |
| CAAUAUUGAUGCUGAGGUU | 4901 | AACCUCAGCAUCAAUAUUG | 4902 |
| AAUAUUGAUGCUGAGGUUC | 4903 | GAACCUCAGCAUCAAUAUU | 4904 |
| AUAUUGAUGCUGAGGUUCU | 4905 | AGAACCUCAGCAUCAAUAU | 4906 |
| UAUUGAUGCUGAGGUUCUU | 4907 | AAGAACCUCAGCAUCAAUA | 4908 |
| AUUGAUGCUGAGGUUCUUC | 4909 | GAAGAACCUCAGCAUCAAU | 4910 |
| UUGAUGCUGAGGUUCUUCU | 4911 | AGAAGAACCUCAGCAUCAA | 4912 |
| UGAUGCUGAGGUUCUUCUA | 4913 | UAGAAGAACCUCAGCAUCA | 4914 |
| GAGGUUCUUCUACUGCUAG | 4915 | CUAGCAGUAGAAGAACCUC | 4916 |
| AGGUUCUUCUACUGCUAGU | 4917 | ACUAGCAGUAGAAGAACCU | 4918 |
| UUUUACUGGUGUGAAUUGG | 4919 | CCAAUUCACACCAGUAAAA | 4920 |
| UUUACUGGUGUGAAUUGGG | 4921 | CCCAAUUCACACCAGUAAA | 4922 |
| UUACUGGUGUGAAUUGGGA | 4923 | UCCCAAUUCACACCAGUAA | 4924 |
| UACUGGUGUGAAUUGGGAA | 4925 | UUCCCAAUUCACACCAGUA | 4926 |
| CUGGUGUGAAUUGGGAAGA | 4927 | UCUUCCCAAUUCACACCAG | 4928 |
| UGGUGUGAAUUGGGAAGAA | 4929 | UUCUUCCCAAUUCACACCA | 4930 |
| UGCUAUUCCAUGACGUUUG | 4931 | CAAACGUCAUGGAAUAGCA | 4932 |
| GCUAUUCCAUGACGUUUGU | 4933 | ACAAACGUCAUGGAAUAGC | 4934 |
| CUAUUCCAUGACGUUUGUA | 4935 | UACAAACGUCAUGGAAUAG | 4936 |
| UAUUCCAUGACGUUUGUAA | 4937 | UUACAAACGUCAUGGAAUA | 4938 |
| AUUCCAUGACGUUUGUAAA | 4939 | UUUACAAACGUCAUGGAAU | 4940 |
| UUCCAUGACGUUUGUAAAA | 4941 | UUUUACAAACGUCAUGGAA | 4942 |
| UCCAUGACGUUUGUAAAAU | 4943 | AUUUUACAAACGUCAUGGA | 4944 |
| CCAUGACGUUUGUAAAAUG | 4945 | CAUUUUACAAACGUCAUGG | 4946 |

TABLE 6-continued

| Sense Sequence | SEQ ID NO: | Antisense Sequence | SEQ ID NO: |
|---|---|---|---|
| CAUGACGUUUGUAAAAUGU | 4947 | ACAUUUUACAAACGUCAUG | 4948 |
| CUUGAGGUUAAAUAAUGGG | 4949 | CCCAUUAUUUAACCUCAAG | 4950 |
| UUGAGGUUAAAUAAUGGGU | 4951 | ACCCAUUAUUUAACCUCAA | 4952 |
| UGAGGUUAAAUAAUGGGUA | 4953 | UACCCAUUAUUUAACCUCA | 4954 |
| GAGGUUAAAUAAUGGGUAG | 4955 | CUACCCAUUAUUUAACCUC | 4956 |
| AGGUUAAAUAAUGGGUAGU | 4957 | ACUACCCAUUAUUUAACCU | 4958 |
| GGUUAAAUAAUGGGUAGUA | 4959 | UACUACCCAUUAUUUAACC | 4960 |
| UAAUAUUAAGGUCCUUGAC | 4961 | GUCAAGGACCUUAAUAUUA | 4962 |
| AAUAUUAAGGUCCUUGACU | 4963 | AGUCAAGGACCUUAAUAUU | 4964 |
| AUAUUAAGGUCCUUGACUA | 4965 | UAGUCAAGGACCUUAAUAU | 4966 |
| UAUUAAGGUCCUUGACUAU | 4967 | AUAGUCAAGGACCUUAAUA | 4968 |
| AUUAAGGUCCUUGACUAUG | 4969 | CAUAGUCAAGGACCUUAAU | 4970 |
| AGGUCCUUGACUAUGUGUA | 4971 | UACACAUAGUCAAGGACCU | 4972 |
| GGUCCUUGACUAUGUGUAC | 4973 | GUACACAUAGUCAAGGACC | 4974 |
| UAAUCUCUGCCAUCUCGCU | 4975 | AGCGAGAUGGCAGAGAUUA | 4976 |
| AUCUCUGCCAUCUCGCUAA | 4977 | UUAGCGAGAUGGCAGAGAU | 4978 |
| UCUCUGCCAUCUCGCUAAA | 4979 | UUUAGCGAGAUGGCAGAGA | 4980 |
| CUCUGCCAUCUCGCUAAAU | 4981 | AUUUAGCGAGAUGGCAGAG | 4982 |
| UCUGCCAUCUCGCUAAAUC | 4983 | GAUUUAGCGAGAUGGCAGA | 4984 |
| CUGCCAUCUCGCUAAAUCA | 4985 | UGAUUUAGCGAGAUGGCAG | 4986 |
| UGCCAUCUCGCUAAAUCAU | 4987 | AUGAUUUAGCGAGAUGGCA | 4988 |
| GCCAUCUCGCUAAAUCAUC | 4989 | GAUGAUUUAGCGAGAUGGC | 4990 |
| CCAUCUCGCUAAAUCAUCA | 4991 | UGAUGAUUUAGCGAGAUGG | 4992 |
| AGGUGCCUGAUCUUCCUAA | 4993 | UUAGGAAGAUCAGGCACCU | 4994 |
| GGUGCCUGAUCUUCCUAAU | 4995 | AUUAGGAAGAUCAGGCACC | 4996 |
| GUGCCUGAUCUUCCUAAUA | 4997 | UAUUAGGAAGAUCAGGCAC | 4998 |
| UGCCUGAUCUUCCUAAUAA | 4999 | UUAUUAGGAAGAUCAGGCA | 5000 |
| GAUCUUCCUAAUAAUUCUG | 5001 | CAGAAUUAUUAGGAAGAUC | 5002 |
| AUCUUCCUAAUAAUUCUGC | 5003 | GCAGAAUUAUUAGGAAGAU | 5004 |
| UCUUCCUAAUAAUUCUGCC | 5005 | GGCAGAAUUAUUAGGAAGA | 5006 |
| CUUCCUAAUAAUUCUGCCU | 5007 | AGGCAGAAUUAUUAGGAAG | 5008 |
| UUCCUAAUAAUUCUGCCUA | 5009 | UAGGCAGAAUUAUUAGGAA | 5010 |
| UCCUAAUAAUUCUGCCUAU | 5011 | AUAGGCAGAAUUAUUAGGA | 5012 |
| UUCUGCCUAUUUUCAUUUG | 5013 | CAAAUGAAAAUAGGCAGAA | 5014 |
| UCUGCCUAUUUUCAUUUGC | 5015 | GCAAAUGAAAAUAGGCAGA | 5016 |
| GCCUAUUUUCAUUUGCUUU | 5017 | AAAGCAAAUGAAAAUAGGC | 5018 |
| AUUUUCUUUCUAGUUGUGG | 5019 | CCACAACUAGAAAGAAAAU | 5020 |
| UUUUCUUUCUAGUUGUGGC | 5021 | GCCACAACUAGAAAGAAAA | 5022 |
| UUCUUUCUAGUUGUGGCUG | 5023 | CAGCCACAACUAGAAAGAA | 5024 |

TABLE 6-continued

| Sense Sequence | SEQ ID NO: | Antisense Sequence | SEQ ID NO: |
|---|---|---|---|
| UCUCCCAAAUAAGAUGUGC | 5025 | GCACAUCUUAUUUGGGAGA | 5026 |
| CUCCCAAAUAAGAUGUGCU | 5027 | AGCACAUCUUAUUUGGGAG | 5028 |
| AAGAUGUGCUGCUUACCGA | 5029 | UCGGUAAGCAGCACAUCUU | 5030 |
| AGAUGUGCUGCUUACCGAG | 5031 | CUCGGUAAGCAGCACAUCU | 5032 |
| GAUGUGCUGCUUACCGAGG | 5033 | CCUCGGUAAGCAGCACAUC | 5034 |
| AUGUGCUGCUUACCGAGGU | 5035 | ACCUCGGUAAGCAGCACAU | 5036 |
| UGUGCUGCUUACCGAGGUA | 5037 | UACCUCGGUAAGCAGCACA | 5038 |
| CUGCUUACCGAGGUAUCAC | 5039 | GUGAUACCUCGGUAAGCAG | 5040 |
| UGCUUACCGAGGUAUCACG | 5041 | CGUGAUACCUCGGUAAGCA | 5042 |
| GCUUACCGAGGUAUCACGG | 5043 | CCGUGAUACCUCGGUAAGC | 5044 |
| CUUACCGAGGUAUCACGGG | 5045 | CCCGUGAUACCUCGGUAAG | 5046 |
| GGCUCCAGCUUGGGUCGUU | 5047 | AACGACCCAAGCUGGAGCC | 5048 |
| GCUCCAGCUUGGGUCGUUG | 5049 | CAACGACCCAAGCUGGAGC | 5050 |
| CUCCAGCUUGGGUCGUUGA | 5051 | UCAACGACCCAAGCUGGAG | 5052 |
| UCCAGCUUGGGUCGUUGAA | 5053 | UUCAACGACCCAAGCUGGA | 5054 |
| CCAGCUUGGGUCGUUGAAG | 5055 | CUUCAACGACCCAAGCUGG | 5056 |
| CUUGGGUCGUUGAAGCUGG | 5057 | CCAGCUUCAACGACCCAAG | 5058 |
| UUGGGUCGUUGAAGCUGGG | 5059 | CCCAGCUUCAACGACCCAA | 5060 |
| CAGCAAGUUUAGCAUCUUC | 5061 | GAAGAUGCUAAACUUGCUG | 5062 |
| CAAUGCCAUCACUUAACUA | 5063 | UAGUUAAGUGAUGGCAUUG | 5064 |
| AUGCCAUCACUUAACUAUA | 5065 | UAUAGUUAAGUGAUGGCAU | 5066 |
| UGCCAUCACUUAACUAUAA | 5067 | UUAUAGUUAAGUGAUGGCA | 5068 |
| GCCAUCACUUAACUAUAAC | 5069 | GUUAUAGUUAAGUGAUGGC | 5070 |
| CCAUCACUUAACUAUAACU | 5071 | AGUUAUAGUUAAGUGAUGG | 5072 |
| CAUCACUUAACUAUAACUC | 5073 | GAGUUAUAGUUAAGUGAUG | 5074 |
| UCUCUUGACCAAAUAGACU | 5075 | AGUCUAUUUGGUCAAGAGA | 5076 |
| CUCUUGACCAAAUAGACUC | 5077 | GAGUCUAUUUGGUCAAGAG | 5078 |
| UCUUGACCAAAUAGACUCA | 5079 | UGAGUCUAUUUGGUCAAGA | 5080 |
| CUUGACCAAAUAGACUCAU | 5081 | AUGAGUCUAUUUGGUCAAG | 5082 |
| UUGACCAAAUAGACUCAUA | 5083 | UAUGAGUCUAUUUGGUCAA | 5084 |
| GACCAAAUAGACUCAUAAU | 5085 | AUUAUGAGUCUAUUUGGUC | 5086 |
| UUUCCUGUUGUACAUUUAG | 5087 | CUAAAUGUACAACAGGAAA | 5088 |
| GGUUAUUCAAAGUUUUCAG | 5089 | CUGAAAACUUUGAAUAACC | 5090 |
| UAUUCAAAGUUUUCAGCUC | 5091 | GAGCUGAAAACUUUGAAUA | 5092 |
| AUUCAAAGUUUUCAGCUCU | 5093 | AGAGCUGAAAACUUUGAAU | 5094 |
| UCAGCUCUUUUUAAAAUUGC | 5095 | GCAAUUUUAAAAGAGCUGA | 5096 |
| CAGCUCUUUUUAAAAUUGCU | 5097 | AGCAAUUUUAAAAGAGCUG | 5098 |
| AGCUCUUUUUAAAAUUGCUC | 5099 | GAGCAAUUUUAAAAGAGCU | 5100 |
| GCUCUUUUUAAAAUUGCUCU | 5101 | AGAGCAAUUUUAAAAGAGC | 5102 |

TABLE 6-continued

| Sense Sequence | SEQ ID NO: | Antisense Sequence | SEQ ID NO: |
|---|---|---|---|
| AAUUGCUCUGAAUAAGUUC | 5103 | GAACUUAUUCAGAGCAAUU | 5104 |
| AUUGCUCUGAAUAAGUUCU | 5105 | AGAACUUAUUCAGAGCAAU | 5106 |
| UUGCUCUGAAUAAGUUCUA | 5107 | UAGAACUUAUUCAGAGCAA | 5108 |
| UGCUCUGAAUAAGUUCUAG | 5109 | CUAGAACUUAUUCAGAGCA | 5110 |
| CUGAAUAAGUUCUAGUGAG | 5111 | CUCACUAGAACUUAUUCAG | 5112 |
| AUAAGUUCUAGUGAGUGAG | 5113 | CUCACUCACUAGAACUUAU | 5114 |
| UUCUAGUGAGUGAGUUAUG | 5115 | CAUAACUCACUCACUAGAA | 5116 |
| UCUAGUGAGUGAGUUAUGG | 5117 | CCAUAACUCACUCACUAGA | 5118 |
| UGAGUUAUGGUGCUGGCUA | 5119 | UAGCCAGCACCAUAACUCA | 5120 |
| GAGUUAUGGUGCUGGCUAU | 5121 | AUAGCCAGCACCAUAACUC | 5122 |
| AGUUAUGGUGCUGGCUAUA | 5123 | UAUAGCCAGCACCAUAACU | 5124 |
| GUUAUGGUGCUGGCUAUAU | 5125 | AUAUAGCCAGCACCAUAAC | 5126 |
| UUAUGGUGCUGGCUAUAUU | 5127 | AAUAUAGCCAGCACCAUAA | 5128 |
| UAUGGUGCUGGCUAUAUUU | 5129 | AAAUAUAGCCAGCACCAUA | 5130 |
| AUGGUGCUGGCUAUAUUUU | 5131 | AAAAUAUAGCCAGCACCAU | 5132 |
| UGGUGCUGGCUAUAUUUUG | 5133 | CAAAAUAUAGCCAGCACCA | 5134 |
| GGUGCUGGCUAUAUUUUGC | 5135 | GCAAAAUAUAGCCAGCACC | 5136 |
| UGCCCUCUCAAAUGUUGCU | 5137 | AGCAACAUUUGAGAGGGCA | 5138 |
| GCCCUCUCAAAUGUUGCUA | 5139 | UAGCAACAUUUGAGAGGGC | 5140 |
| CCCUCUCAAAUGUUGCUAG | 5141 | CUAGCAACAUUUGAGAGGG | 5142 |
| CCUCUCAAAUGUUGCUAGG | 5143 | CCUAGCAACAUUUGAGAGG | 5144 |
| CUCUCAAAUGUUGCUAGGA | 5145 | UCCUAGCAACAUUUGAGAG | 5146 |
| AAAUGUUGCUAGGAAUUCA | 5147 | UGAAUUCCUAGCAACAUUU | 5148 |
| AAUGUUGCUAGGAAUUCAU | 5149 | AUGAAUUCCUAGCAACAUU | 5150 |
| AUGUUGCUAGGAAUUCAUA | 5151 | UAUGAAUUCCUAGCAACAU | 5152 |
| UGUUGCUAGGAAUUCAUAC | 5153 | GUAUGAAUUCCUAGCAACA | 5154 |
| GUUGCUAGGAAUUCAUACU | 5155 | AGUAUGAAUUCCUAGCAAC | 5156 |
| UUGCUAGGAAUUCAUACUG | 5157 | CAGUAUGAAUUCCUAGCAA | 5158 |
| UGCUAGGAAUUCAUACUGC | 5159 | GCAGUAUGAAUUCCUAGCA | 5160 |
| AAAGCAAUGAAUAAGCAUG | 5161 | CAUGCUUAUUCAUUGCUUU | 5162 |
| AAGCAAUGAAUAAGCAUGC | 5163 | GCAUGCUUAUUCAUUGCUU | 5164 |
| AGCAAUGAAUAAGCAUGCC | 5165 | GGCAUGCUUAUUCAUUGCU | 5166 |
| GCAAUGAAUAAGCAUGCCU | 5167 | AGGCAUGCUUAUUCAUUGC | 5168 |
| AAUGAAUAAGCAUGCCUGU | 5169 | ACAGGCAUGCUUAUUCAUU | 5170 |
| AUGAAUAAGCAUGCCUGUU | 5171 | AACAGGCAUGCUUAUUCAU | 5172 |
| UGAAUAAGCAUGCCUGUUU | 5173 | AAACAGGCAUGCUUAUUCA | 5174 |
| GAAUAAGCAUGCCUGUUUU | 5175 | AAAACAGGCAUGCUUAUUC | 5176 |
| AUAAGCAUGCCUGUUUUCC | 5177 | GGAAAACAGGCAUGCUUAU | 5178 |
| AUGCCUGUUUUCCCAUGGC | 5179 | GCCAUGGGAAAACAGGCAU | 5180 |

TABLE 6-continued

| Sense Sequence | SEQ ID NO: | Antisense Sequence | SEQ ID NO: |
|---|---|---|---|
| UGCCUGUUUUCCCAUGGCC | 5181 | GGCCAUGGGAAAACAGGCA | 5182 |
| GCCUGUUUUCCCAUGGCCU | 5183 | AGGCCAUGGGAAAACAGGC | 5184 |
| CCUGUUUUCCCAUGGCCUU | 5185 | AAGGCCAUGGGAAAACAGG | 5186 |
| CUGUUUUCCCAUGGCCUUG | 5187 | CAAGGCCAUGGGAAAACAG | 5188 |
| UUCCCAUGGCCUUGCUUGC | 5189 | GCAAGCAAGGCCAUGGGAA | 5190 |
| GGCCUUGCUUGCCAGAAUU | 5191 | AAUUCUGGCAAGCAAGGCC | 5192 |
| UUGCUUGCCAGAAUUUGAC | 5193 | GUCAAAUUCUGGCAAGCAA | 5194 |
| UGCUUGCCAGAAUUUGACU | 5195 | AGUCAAAUUCUGGCAAGCA | 5196 |
| GCUUGCCAGAAUUUGACUU | 5197 | AAGUCAAAUUCUGGCAAGC | 5198 |
| CUUGCCAGAAUUUGACUUU | 5199 | AAAGUCAAAUUCUGGCAAG | 5200 |
| UUGCCAGAAUUUGACUUUU | 5201 | AAAAGUCAAAUUCUGGCAA | 5202 |
| GAUAUACUACUAUUGCUUG | 5203 | CAAGCAAUAGUAGUAUAUC | 5204 |
| AUAUUGUGGUAUACGGUGU | 5205 | ACACCGUAUACCACAAUAU | 5206 |
| UAUUGUGGUAUACGGUGUC | 5207 | GACACCGUAUACCACAAUA | 5208 |
| AUUGUGGUAUACGGUGUCA | 5209 | UGACACCGUAUACCACAAU | 5210 |
| UUGUGGUAUACGGUGUCAG | 5211 | CUGACACCGUAUACCACAA | 5212 |
| UGUGGUAUACGGUGUCAGG | 5213 | CCUGACACCGUAUACCACA | 5214 |
| GUGGUAUACGGUGUCAGGU | 5215 | ACCUGACACCGUAUACCAC | 5216 |
| UAUACGGUGUCAGGUUUCA | 5217 | UGAAACCUGACACCGUAUA | 5218 |
| AUACGGUGUCAGGUUUCAG | 5219 | CUGAAACCUGACACCGUAU | 5220 |
| UACGGUGUCAGGUUUCAGG | 5221 | CCUGAAACCUGACACCGUA | 5222 |
| UGUCAGGUUUCAGGGUUUU | 5223 | AAAACCCUGAAACCUGACA | 5224 |
| UUCAUUUCAAAUACUCCCU | 5225 | AGGGAGUAUUUGAAAUGAA | 5226 |
| CAUUUCAAAUACUCCCUUU | 5227 | AAAGGGAGUAUUUGAAAUG | 5228 |
| UAGGUAUAACUGUUGAUGA | 5229 | UCAUCAACAGUUAUACCUA | 5230 |
| AGGUAUAACUGUUGAUGAA | 5231 | UUCAUCAACAGUUAUACCU | 5232 |
| UUAUUGUCCAUUUAUACCC | 5233 | GGGUAUAAAUGGACAAUAA | 5234 |
| UAUUGUCCAUUUAUACCCU | 5235 | AGGGUAUAAAUGGACAAUA | 5236 |
| AUUGUCCAUUUAUACCCUG | 5237 | CAGGGUAUAAAUGGACAAU | 5238 |
| UUGUCCAUUUAUACCCUGU | 5239 | ACAGGGUAUAAAUGGACAA | 5240 |
| UGUCCAUUUAUACCCUGUA | 5241 | UACAGGGUAUAAAUGGACA | 5242 |
| GUCCAUUUAUACCCUGUAA | 5243 | UUACAGGGUAUAAAUGGAC | 5244 |
| UAUACCCUGUAAAGCCGUU | 5245 | AACGGCUUUACAGGGUAUA | 5246 |
| AUACCCUGUAAAGCCGUUU | 5247 | AAACGGCUUUACAGGGUAU | 5248 |
| UACCCUGUAAAGCCGUUUU | 5249 | AAAACGGCUUUACAGGGUA | 5250 |
| AGCCGUUUUAGAAUGUAAU | 5251 | AUUACAUUCUAAAACGGCU | 5252 |
| GCCGUUUUAGAAUGUAAUA | 5253 | UAUUACAUUCUAAAACGGC | 5254 |
| AGGUAAUCCAAAAUGUACU | 5255 | AGUACAUUUUGGAUUACCU | 5256 |
| GGUAAUCCAAAAUGUACUA | 5257 | UAGUACAUUUUGGAUUACC | 5258 |

TABLE 6-continued

| Sense Sequence | SEQ ID NO: | Antisense Sequence | SEQ ID NO: |
|---|---|---|---|
| ACAUUUGUAUUGUCUCUUC | 5259 | GAAGAGACAAUACAAAUGU | 5260 |
| CAUUUGUAUUGUCUCUUCU | 5261 | AGAAGAGACAAUACAAAUG | 5262 |
| UUGUAUCGCAAAGCUAUAU | 5263 | AUAUAGCUUUGCGAUACAA | 5264 |
| UGUAUCGCAAAGCUAUAUG | 5265 | CAUAUAGCUUUGCGAUACA | 5266 |
| GUAUCGCAAAGCUAUAUGU | 5267 | ACAUAUAGCUUUGCGAUAC | 5268 |
| UAUCGCAAAGCUAUAUGUG | 5269 | CACAUAUAGCUUUGCGAUA | 5270 |
| AUCGCAAAGCUAUAUGUGC | 5271 | GCACAUAUAGCUUUGCGAU | 5272 |
| UCGCAAAGCUAUAUGUGCA | 5273 | UGCACAUAUAGCUUUGCGA | 5274 |
| UGAUCUAUGCUUUGAGUUU | 5275 | AAACUCAAAGCAUAGAUCA | 5276 |
| GAUCUAUGCUUUGAGUUUG | 5277 | CAAACUCAAAGCAUAGAUC | 5278 |
| AUCUAUGCUUUGAGUUUGC | 5279 | GCAAACUCAAAGCAUAGAU | 5280 |
| UCUAUGCUUUGAGUUUGCU | 5281 | AGCAAACUCAAAGCAUAGA | 5282 |
| CUAUGCUUUGAGUUUGCUU | 5283 | AAGCAAACUCAAAGCAUAG | 5284 |
| UAUGCUUUGAGUUUGCUUU | 5285 | AAAGCAAACUCAAAGCAUA | 5286 |
| AUGCUUUGAGUUUGCUUUC | 5287 | GAAAGCAAACUCAAAGCAU | 5288 |
| AUCUUACCUAAAAGUACUG | 5289 | CAGUACUUUUAGGUAAGAU | 5290 |
| CUUACCUAAAAGUACUGAA | 5291 | UUCAGUACUUUUAGGUAAG | 5292 |

In some embodiments, the antisense nucleic acid molecules targeted to HLA-A comprise or consist of the nucleotide sequences shown in Table 7.

TABLE 7

| Sequence | SEQ ID NO: |
|---|---|
| GUCACUGCUUGCAGCCUGAG | 5293 |
| UGUCACUGCUUGCAGCCUGA | 5294 |
| CUGUCACUGCUUGCAGCCUG | 5295 |
| ACUGUCACUGCUUGCAGCCU | 5296 |
| CACUGUCACUGCUUGCAGCC | 5297 |
| GCACUGUCACUGCUUGCAGC | 5298 |
| GGCACUGUCACUGCUUGCAG | 5299 |

TABLE 7-continued

| Sequence | SEQ ID NO: |
|---|---|
| GGGCACUGUCACUGCUUGCA | 5300 |
| UGGGCACUGUCACUGCUUGC | 5301 |
| UCUCACACUUUACAAGCUGU | 5302 |
| GUCUCACACUUUACAAGCUG | 5303 |
| UGUCUCACACUUUACAAGCU | 5304 |
| CUGUCUCACACUUUACAAGC | 5305 |
| GCUGUCUCACACUUUACAAG | 5306 |
| AGCUGUCUCACACUUUACAA | 5307 |

In some embodiments, the siRNA molecules targeted to HLA-A comprise or consist of the nucleotide sequences (sense and antisense strands) shown in Table 8.

TABLE 8

| Sense Sequence | SEQ ID NO: | Antisense Sequence | SEQ ID NO: |
|---|---|---|---|
| GGCUGCAAGCAGUGACAGU | 5308 | ACUGUCACUGCUUGCAGCC | 5309 |
| GCUGCAAGCAGUGACAGUG | 5310 | CACUGUCACUGCUUGCAGC | 5311 |
| CUGCAAGCAGUGACAGUGC | 5312 | GCACUGUCACUGCUUGCAG | 5313 |
| UGCAAGCAGUGACAGUGCC | 5314 | GGCACUGUCACUGCUUGCA | 5315 |
| GCAAGCAGUGACAGUGCCC | 5316 | GGGCACUGUCACUGCUUGC | 5317 |

TABLE 8-continued

| Sense Sequence | SEQ ID NO: | Antisense Sequence | SEQ ID NO: |
|---|---|---|---|
| CAAGCAGUGACAGUGCCCA | 5318 | UGGGCACUGUCACUGCUUG | 5319 |
| CUCACAGCUUGUAAAGUGU | 5320 | ACACUUUACAAGCUGUGAG | 5321 |

In some embodiments, the antisense nucleic acid molecules targeted to HLA-B comprise or consist of the nucleotide sequences shown in Table 9.

TABLE 9

| Sequence | SEQ ID NO: |
|---|---|
| UGCACGCAGCCUGAGAGUAG | 5322 |
| CUGCACGCAGCCUGAGAGUA | 5323 |

In some embodiments, the siRNA molecules targeted to HLA-B comprise or consist of the nucleotide sequences (sense and antisense strands) shown in Table 10.

TABLE 10

| Sense Sequence | SEQ ID NO: | Antisense Sequence | SEQ ID NO: |
|---|---|---|---|
| CUACUCUCAGGCUGCGUGC | 5324 | GCACGCAGCCUGAGAGUAG | 5325 |
| UACUCUCAGGCUGCGUGCA | 5326 | UGCACGCAGCCUGAGAGUA | 5327 |

In some embodiments, the antisense nucleic acid molecules targeted to HLA-C comprise or consist of the nucleotide sequences shown in Table 11.

TABLE 11

| Sequence | SEQ ID NO: |
|---|---|
| GCUGUCUCAGGCUUUACAAG | 5328 |
| AGCUGUCUCAGGCUUUACAA | 5329 |

In some embodiments, the siRNA molecules targeted to HLA-C comprise or consist of the nucleotide sequences (sense and antisense strands) shown in Table 12.

TABLE 12

| Sense Sequence | SEQ ID NO: | Antisense Sequence | SEQ ID NO: |
|---|---|---|---|
| UGCUCUCAGGCUGCGUGCA | 5330 | UGCACGCAGCCUGAGAGCA | 5331 |

The inhibitory nucleic acid molecules disclosed herein can comprise RNA, DNA, or both RNA and DNA. The inhibitory nucleic acid molecules can also be linked or fused to a heterologous nucleic acid sequence, such as in a vector, or a heterologous label. For example, the inhibitory nucleic acid molecules disclosed herein can be within a vector or as an exogenous donor sequence comprising the inhibitory nucleic acid molecule and a heterologous nucleic acid sequence. The inhibitory nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed inhibitory nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The inhibitory nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, $-O[(CH_2)_nO]_mCH_3$, $-O(CH_2)_nOCH_3$, $-O(CH_2)_nNH_2$, $-O(CH_2)_nCH_3$, $-O(CH_2)_n-ONH_2$, and $-O(CH_2)_nON[(CH_2)_nCH_3)]_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:

Sense: mN\*mN\*/i2FN/mN/i2FN/mN/i2FN/mN/i2FN/
mN/i2FN/mN/i2FN/mN/i2FN/mN/i2FN/\*mN\*/
32FN/

Antisense:/52FN/\*/i2FN/\*mN/i2FN/mN/i2FN/mN/
i2FN/mN/i2FN/mN/i2FN/mN/i2FN/mN/i2FN/
mN/i2FN/mN\*N\*N wherein: "N" is the base; "2F" is a 2'-F modification; "m" is a 2'-O-methyl modification, "I" is an internal base; and "\*" is a phosphorothioate backbone linkage.

The present disclosure also provides vectors comprising any one or more of the inhibitory nucleic acid molecules disclosed herein. In some embodiments, the vectors comprise any one or more of the inhibitory nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

The present disclosure also provides compositions comprising any one or more of the inhibitory nucleic acid molecules disclosed herein. In some embodiments, the composition is a pharmaceutical composition. In some embodiments, the compositions comprise a carrier and/or excipient. Examples of carriers include, but are not limited to, poly (lactic acid) (PLA) microspheres, poly(D,L-lactic-cogly-colic-acid) (PLGA) microspheres, liposomes, micelles, inverse micelles, lipid cochleates, and lipid microtubules. A carrier may comprise a buffered salt solution such as PBS, HBSS, etc.

The present disclosure also provides methods of identifying a subject having an increased risk for developing an MHC-I-opathy and/or an MHC-II-opathy. The methods comprise performing or having performed an assay on a biological sample from the subject to determine whether the subject comprises: i) an MHC-I-opathy-related HLA genotype and/or an MHC-II-opathy-related HLA genotype; and ii) a functional ERAP2 protein or a nucleic acid molecule encoding a functional ERAP2 protein. When the subject has both the MHC-I-opathy-related HLA genotype and/or an MHC-II-opathy-related HLA genotype and the functional ERAP2 protein or the nucleic acid molecule encoding the functional ERAP2 protein, then the subject has an increased risk of developing the MHC-I-opathy and/or an MHC-II-opathy. When the subject lacks the MHC-I-opathy-related HLA genotype and/or an MHC-II-opathy-related HLA genotype, or lacks the functional ERAP2 protein or the nucleic acid molecule encoding the functional ERAP2 protein, or lacks both, then the subject has a decreased risk of developing the MHC-I-opathy and/or an MHC-II-opathy. In some embodiments, the method further comprises determining whether the subject has a single copy of the MHC-I-opathy-related HLA genotype and/or an MHC-II-opathy-related HLA genotype or two copies of the MHC-I-opathy-related HLA genotype and/or an MHC-II-opathy-related HLA genotype. When the subject comprises two copies of the MHC-I-opathy-related HLA genotype and/or an MHC-II-opathy-related HLA genotype, then the subject has an increased risk of developing the MHC-I-opathy and/or an MHC-II-opathy compared to comprising a single copy of the MHC-I-opathy-related HLA genotype and/or an MHC-II-opathy-related HLA genotype.

In some embodiments, the MHC-I-opathy is BSCR. In some embodiments, the subject is HLA-Aw19$^+$. In some embodiments, the subject is or is suspected of being HLA-A*29$^+$, HLA-A*30$^+$, HLA-A*31$^+$, or HLA-A*33$^+$, or any combination thereof. In some embodiments, the subject has a single copy of HLA-Aw19. In some embodiments, the subject has two copies of HLA-Aw19. In some embodiments, the subject is HLA-A*29$^+$/HLA-A*30$^+$. In some embodiments, the subject is HLA-A*29$^+$/HLA-A*31$^+$. In some embodiments, the subject is HLA-A*29$^+$/HLA-A*33$^+$.

In some embodiments, the subject having BSCR is not HLA-A*29$^+$.

In some embodiments, the subject having BSCR has a copy of at least any two of HLA-A*29, HLA-A*30, HLA-A*31, or HLA-A*33. In some embodiments, the subject having BSCR has a copy of at least any three of HLA-A*29, HLA-A*30, HLA-A*31, or HLA-A*33. In some embodiments, the subject having BSCR has a copy of all of HLA-A*29, HLA-A*30, HLA-A*31, or HLA-A*33.

In some embodiments, the subject having BSCR has one copy of each HLA-A*29 and HLA-A*30. In some embodiments, the subject having BSCR has one copy of each HLA-A*29 and HLA-A*31. In some embodiments, the subject having BSCR has one copy of each HLA-A*29 and HLA-A*33. In some embodiments, the subject having BSCR has one copy of each HLA-A*30 and HLA-A*31. In some embodiments, the subject having BSCR has one copy of each HLA-A*30 and HLA-A*33. In some embodiments, the subject having BSCR has one copy of each HLA-A*31 and HLA-A*33.

In some embodiments, the subject having BSCR has one copy of HLA-A*29 and two copies of HLA-A*30. In some embodiments, the subject having BSCR has one copy of HLA-A*29 and two copies of HLA-A*31. In some embodiments, the subject having BSCR has one copy of HLA-A*29 and two copies of HLA-A*33. In some embodiments, the subject having BSCR has one copy of HLA-A*30 and two copies of HLA-A*31. In some embodiments, the subject having BSCR has one copy of HLA-A*30 and two copies HLA-A*33. In some embodiments, the subject having BSCR has one copy of HLA-A*31 and two copies of HLA-A*33.

In some embodiments, the subject having BSCR has two copies of HLA-A*29 and one copy of HLA-A*30. In some embodiments, the subject having BSCR has two copies of HLA-A*29 and one copy of HLA-A*31. In some embodiments, the subject having BSCR has two copies of HLA-A*29 and one copy of HLA-A*33. In some embodiments, the subject having BSCR has two copies of HLA-A*30 and one copy of HLA-A*31. In some embodiments, the subject having BSCR has two copies of HLA-A*30 and one copy of HLA-A*33. In some embodiments, the subject having BSCR has two copies of HLA-A*31 and one copy of HLA-A*33.

In some embodiments, the subject having BSCR or suspected of having BSCR has two copies of HLA-A*29 and two copies of HLA-A*30. In some embodiments, the subject having BSCR or suspected of having BSCR has two copies of HLA-A*29 and two copies of HLA-A*31. In some embodiments, the subject having BSCR or suspected of having BSCR has two copies of HLA-A*29 and two copies of HLA-A*33. In some embodiments, the subject having BSCR or suspected of having BSCR has two copies of HLA-A*30 and two copies of HLA-A*31. In some embodiments, the subject having BSCR or suspected of having BSCR has two copies of HLA-A*30 and two copies of HLA-A*33. In some embodiments, the subject having BSCR or suspected of having BSCR has two copies of HLA-A*31 and two copies of HLA-A*33.

In some embodiments, the method further comprises administering to the subject an HLA-Aw19 inhibitor. In some embodiments, the HLA-Aw19 inhibitor is an antibody. In some embodiments, the antibody is an anti-HLA-A*29 antibody. In some embodiments, the HLA-Aw19 inhibitor comprises a small molecule degrader or an inhibitory nucleic acid molecule. In some embodiments, the inhibitory nucleic acid molecule is an antisense nucleic acid molecule, a small interfering RNA (siRNA), or a short hairpin RNA (shRNA) that hybridizes to an HLA-Aw19. In some embodiments, the HLA-Aw19 is HLA-A*29.

In some embodiments, the MHC-I-opathy is AS. In some embodiments, the subject is or is suspected of being HLA-B*27$^+$ or HLA-B*40$^+$. In some embodiments, the subject has a single copy of HLA-B*27 or HLA-B*40. In some embodiments, the subject has two copies of HLA-B*27 or HLA-B*40. In some embodiments, the method further comprises administering to the subject an HLA-B*27 inhibitor or an HLA-B*40 inhibitor. In some embodiments, the HLA-B*27 inhibitor or HLA-B*40 inhibitor is an antibody. In some embodiments, the antibody is an anti-HLA-B*27 antibody or an anti-HLA-B*40 antibody. In some embodiments, the HLA-B*27 inhibitor or HLA-B*40 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*27 or HLA-B*40.

In some embodiments, the MHC-I-opathy is Behçet's disease. In some embodiments, the subject is or is suspected of being HLA-B*51⁺. In some embodiments, the subject has a single copy of HLA-B*51. In some embodiments, the subject has two copies of HLA-B*51. In some embodiments, the method further comprises administering to the subject an HLA-B*51 inhibitor. In some embodiments, the HLA-B*51 inhibitor is an antibody. In some embodiments, the antibody is an anti-HLA-B*51 antibody. In some embodiments, the HLA-B*51 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*51.

In some embodiments, the MHC-I-opathy is psoriasis. In some embodiments, the subject is or is suspected of being HLA-C*06⁺. In some embodiments, the subject has a single copy of HLA-C*06. In some embodiments, the subject has two copies of HLA-C*06. In some embodiments, the method further comprises administering to the subject an HLA-C*06 inhibitor. In some embodiments, the HLA-C*06 inhibitor is an antibody. In some embodiments, the antibody is an anti-HLA-C*06 antibody. In some embodiments, the HLA-C*06 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-C*06.

In some embodiments, the MHC-I-opathy is JIA. In some embodiments, the subject is or is suspected of being HLA-B*27+ and/or DRB1⁺. In some embodiments, the subject has a single copy of HLA-B*27 and/or DRB1. In some embodiments, the subject has two copies of HLA-B*27 and/or DRB1. In some embodiments, the method further comprises administering to the subject an HLA-B*27 inhibitor and/or a DRB1 inhibitor. In some embodiments, the HLA-B*27 inhibitor and/or DRB1 inhibitor is an antibody. In some embodiments, the antibody is an anti-HLA-B*27 antibody or an anti-DRB1 antibody. In some embodiments, the HLA-B*27 inhibitor and/or DRB1 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-B*27 and/or an DRB1.

In some embodiments, the MHC-I-opathy is IBD or CD. In some embodiments, the subject is or is suspected of being HLA-C*07⁺. In some embodiments, the subject has a single copy of HLA-C*07. In some embodiments, the subject has two copies of HLA-C*07. In some embodiments, the method further comprises administering to the subject an HLA-C*07 inhibitor. In some embodiments, the HLA-C*07 inhibitor is an antibody. In some embodiments, the antibody is an anti-HLA-C*07 antibody. In some embodiments, the HLA-C*07 inhibitor comprises a small molecule degrader or an inhibitory nucleic acid molecule. In some embodiments, the inhibitory nucleic acid molecule is an antisense nucleic acid molecule, an siRNA, or an shRNA that hybridizes to an HLA-C*07.

In any of the embodiments described herein, the methods can further comprise administering to the subject having an increased risk of developing the MHC-I-opathy-related HLA genotype and/or an MHC-II-opathy an ERAP2 inhibitor. In some embodiments, the ERAP2 inhibitor comprises a small molecule degrader, a proteoloysis-targeting chimera, an immunomodulatory drug, or an inhibitory nucleic acid molecule. In some embodiments, the inhibitory nucleic acid molecule is an antisense nucleic acid molecule, an siRNA, or an shRNA that hybridizes to ERAP2 mRNA. In some embodiments, the inhibitory nucleic acid molecule is an antisense nucleic acid molecule that hybridizes to ERAP2 mRNA. In some embodiments, the inhibitory nucleic acid molecule is an siRNA that hybridizes to ERAP2 mRNA. In some embodiments, the inhibitory nucleic acid molecule is an shRNA that hybridizes to ERAP2 mRNA. In some embodiments, the ERAP2 inhibitor comprises an anti-ERAP2 antibody. In some embodiments, the ERAP2 inhibitor comprises a pseudopeptide. In some embodiments, the pseudopeptide is a phosphinic pseudopeptide. In some embodiments, the phosphinic pseudopeptide is DG002 or DG013. In some embodiments, the phosphinic pseudopeptide is DG002. In some embodiments, the phosphinic pseudopeptide is DG013. In some embodiments, the ERAP2 inhibitor comprises a small molecule.

In any of the embodiments described herein, the assay performed or having been performed on the biological sample from the subject can further determine whether the subject comprises a functional ERAP1 protein or a nucleic acid molecule encoding a functional ERAP1 protein. When the subject has the MHC-I-opathy-related HLA genotype and/or MHC-II-opathy-related HLA genotype and lacks the functional ERAP1 protein or the nucleic acid molecule encoding the functional ERAP1 protein, then the subject has an increased risk of developing the MHC-I-opathy (for MHC-I-opathies except AS and psoriasis) and/or MHC-II-opathy. When the subject has the MHC-I-opathy-related HLA genotype and/or MHC-II-opathy-related HLA genotype and has a functional ERAP1 protein or a nucleic acid molecule encoding the functional ERAP1 protein, then the subject has an increased risk of developing the MHC-I-opathy (for AS and psoriasis). When the subject lacks the MHC-I-opathy-related HLA genotype and/or MHC-II-opathy-related HLA genotype, or has the functional ERAP1 protein or the nucleic acid molecule encoding the functional ERAP1 protein, or both, then the subject has a decreased risk of developing the MHC-I-opathy and/or MHC-II-opathy.

In any of the embodiments described herein, the methods can further comprise administering to the subject an ERAP1 agonist or inhibitor, depending upon the MHC-I-opathy. For AS and psoriasis, an ERAP1 inhibitor can be administered. For the remaining MHC-I-opathies, an ERAP1 agonist can be administered.

In some embodiments, the ERAP1 agonist comprises an oligonucleotide. In some embodiments, the oligonucleotide is ODN1826. In some embodiments, the ERAP1 agonist comprises a peptide. In some embodiments, the ERAP1 agonist comprises a lipopeptide. In some embodiments, the lipopeptide is Pam3CSK4 or FSL-1. In some embodiments, the lipopeptide is Pam3CSK4. In some embodiments, the lipopeptide is FSL-1. In some embodiments, the ERAP1 agonist comprises a small molecule. In some embodiments, the ERAP1 agonist can comprise an ERAP1-specific transcriptional activator, an ERAP1 protein stabilizer, an agonist of ERAP1 enzymatic activity, or an activator of ERAP1 secretion. In some embodiments, the ERAP1 agonist can comprise an ERAP1-specific transcriptional activator. In some embodiments, the ERAP1 agonist can comprise an ERAP1 protein stabilizer. In some embodiments, the ERAP1 agonist can comprise an agonist of ERAP1 enzymatic activity. In some embodiments, the ERAP1 agonist can comprise an activator of ERAP1 secretion. Additional examples of ERAP1 agonists are described in, for example, Goto et al., J. Immunol., 2014, 192, 4443-4452.

In some embodiments, the ERAP1 inhibitor comprises a small molecule degrader, a proteoloysis-targeting chimera, an immunomodulatory drug, or an inhibitory nucleic acid molecule. In some embodiments, the inhibitory nucleic acid molecule is an antisense nucleic acid molecule, an siRNA, or an shRNA that hybridizes to ERAP1 mRNA. In some embodiments, the inhibitory nucleic acid molecule is an antisense nucleic acid molecule that hybridizes to ERAP1 mRNA. In some embodiments, the inhibitory nucleic acid molecule is an siRNA that hybridizes to ERAP1 mRNA. In some embodiments, the inhibitory nucleic acid molecule is an shRNA that hybridizes to ERAP1 mRNA. In some embodiments, the ERAP1 inhibitor comprises an anti-ERAP1 antibody.

In some embodiments, the assay for determining whether the subject comprises an MHC-I-opathy-related and/or MHC-II-opathy-related HLA genotype and a functional ERAP2 protein and/or ERAP1 protein, or a nucleic acid molecule encoding a functional ERAP2 protein and/or ERAP1 protein, is a genotyping assay or sequencing assay. In some embodiments, the nucleic acid molecule encoding a functional ERAP2 protein and/or ERAP1 protein comprises genomic DNA, mRNA, or cDNA obtained from mRNA. By comparing the nucleotide or protein sequence of the ERAP2 protein and/or ERAP1 protein in the sample from a subject to the wild type sequence for ERAP2 protein and/or ERAP1 protein or nucleic acid molecule, or to published sequences of variant ERAP2 proteins and/or ERAP1 proteins or nucleic acid molecules having reduced or no activity, a determination can be made whether the subject comprises a functional ERAP2 protein and/or ERAP1 protein, or a nucleic acid molecule encoding a functional ERAP2 protein and/or ERAP1 protein. In addition, although an individual ERAP2 protein and/or ERAP1 protein may have biological activity, the overall function of the ERAP2 protein and/or ERAP1 protein may not be functional due to reduced levels of expression. Thus, as used herein, an ERAP2 protein and/or ERAP1 protein can be determined not to be functional because the ERAP2 protein and/or ERAP1 protein lacks or had reduced biological activity or because the expression level is reduced.

Determining whether a subject has an MHC-I-opathy-related and/or MHC-II-opathy-related HLA genotype and/or a functional ERAP2 protein and/or ERAP1 protein, or a nucleic acid molecule encoding a functional ERAP2 protein and/or ERAP1 protein, in a biological sample from a subject can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a biological sample obtained from the subject.

The biological sample can be derived from any cell, tissue, or biological fluid from the subject. The biological sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any particular nucleic acid molecule, preliminary processing designed to isolate or enrich the biological sample for the particular nucleic acid molecule can be employed. A variety of techniques may be used for this purpose. Various methods to detect the presence or level of an mRNA molecule or the presence of a particular genomic DNA locus can be used.

In some embodiments, the biological sample comprises a cell or cell lysate. Such methods can further comprise, for example, obtaining a biological sample from the subject comprising genomic nucleic acid molecules or mRNA molecules, and if mRNA, optionally reverse transcribing the mRNA into cDNA. In some embodiments, the method is an in vitro method. In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

Detecting the presence or absence of any particular HLA allele can be carried out by numerous techniques. Detection of HLA-A alleles on a 2-digit and 4-digit resolution can be carried out. For example, an assay that targets the HLA region in high resolution (all class-I and class-II genes) can be used. In some embodiments, the assay amplifies the full HLA gene (in this case HLA-A) from the 5'UTR to the 3'UTR and provides genetic variants across the full ampli-con (the DNA that is the product of this amplification of the gene). A method can then be used to call the HLA-A alleles with high accuracy (e.g., PHLAT2; Bai et al., Methods Mol. Biol., 2018, 1802, 193-201). The output of PHLAT2 provides the HLA-A 4-digits allele data for each sample, which can be used for the analysis that identified other Aw19 alleles as enriched in Birdshot cases. In addition, commercial sources of HLA typing are available.

Detecting the presence or absence a functional ERAP2 protein and/or ERAP1 protein, or a nucleic acid molecule encoding a functional ERAP2 protein and/or ERAP1 protein, can be carried out by numerous techniques. For example, detection of presence or absence of ERAP2 protein and the relevant nucleotide sequence can be carried out as described in Andres et al., PLoS Genetics, 2010, 6, 1-13. For example, a subject having an ERAP2 intronic variant designated rs2248374-A has a functional ERAP2 protein, or a nucleic acid molecule encoding a functional ERAP2 protein, and has an increased risk of developing the MHC-I-opathy. A subject having an ERAP2 variant designated rs10044354, HapA has a functional ERAP2 protein, or a nucleic acid molecule encoding a functional ERAP2 protein, and has an increased risk of developing the MHC-I-opathy. In addition, a subject having an ERAP1 intronic variant designated rs27432-G does not have a functional ERAP1 protein, or a nucleic acid molecule encoding a functional ERAP1 protein, and has an increased risk of developing the MHC-I-opathy. A subject having an ERAP1 variant designated rs2287987, Hap 10 does not have a functional ERAP1 protein, or a nucleic acid molecule encoding a functional ERAP1 protein, and has an increased risk of developing the MHC-I-opathy. A subject having an ERAP2 splice variant designated rs2248374-G does not have a functional ERAP2 protein, or a nucleic acid molecule encoding a functional ERAP2 protein, and has a decreased risk of developing the MHC-I-opathy.

In order that the subject matter disclosed herein may be more efficiently understood, examples are provided below. It should be understood that these examples are for illustrative purposes only and are not to be construed as limiting the claimed subject matter in any manner. Throughout these examples, molecular cloning reactions, and other standard recombinant DNA techniques, were carried out according to methods described in Maniatis et al., Molecular Cloning—A Laboratory Manual, 2nd ed., Cold Spring Harbor Press (1989), using commercially available reagents, except where otherwise noted.

EXAMPLES

Example 1: Methods

Study Subjects and Samples

The genomic DNA samples from 286 patients with BSCR and 108 unrelated healthy local French volunteers that exhibited HLA tissue typing common in the French population were included in this study. The patients were recruited at Hopital Cochin, Paris, France. All patients met the criteria for diagnosis of BSCR as defined both by an international consensus conference held in 2002 and by the Standardization of Uveitis Nomenclature (SUN) Working Group. In brief, all patients had a posterior bilateral uveitis with multifocal cream-colored or yellow-orange, oval or round choroidal lesions ("birdshot spots"). Although the presence of the HLA-A*29 allele was not a requirement for the diagnosis of BSCR according to the international criteria, all patients included in the current study carried the HLA-A*29 allele. The control DNA samples were collected from volunteer donors recruited by the hematopoietic stem cell donor center of Rheims for France Greffe de Moelle Registry, and local control healthy individuals of the Registry. The DNA samples were isolated from peripheral blood samples using a standard salting out method or QlAamp Blood Kit (Qiagen, Chatsworth, CA, USA). Quality and quantity of DNA was determined by UV spectrophotometry and the concentration was adjusted to 100 ng/ml. Signed informed consent documentation was obtained from all participants, and all research adhered to the tenets set forth in the Declaration of Helsinki. All study-related data acquisitions were approved by the Paris Cochin institutional review board.

Genetic Data

A comprehensive approach was taken to both sequence the exomes and genotype all samples, to allow for identification of common and rare variants filtered based on high quality calls. DNA from participants was genotyped on the Illumina Global Screening Array (GSA) and imputed to the HRC reference panel. Prior to imputation, the variants that had a MAF>=0.1%, missingness <1% and HWE p-value >$10^{-15}$ were retained. Imputation using the HRC reference panel yielded 8,385,561 variants with imputation INFO>0.3 and MAF>0.5%.

Exome sequencing was performed to a mean depth of 31X, followed by variant calling and quality control as reported previously (Van Hout et al., Nature, 2020, 586, 749-756), resulting in 238,942 variants. When integrated, this produced an overall dataset with 8,459,907 variants: 65.5% common (MAF>5%), 34.5% low-frequency (0.5%<MAF<5%) and 0.01% rare (MAF<0.5%).

HLA Genotyping

HLA Class I genes (HLA-A, -B, and -C) were amplified in a multiplex PCR reaction with primers encompassing the full genomic loci for each target. The resulting amplicons were enzymatically fragmented to an average size of 250 base pairs and prepared for Illumina sequencing (New England Biolabs, Ipswich, MA). The libraries were sequenced on the Illumina HiSeq 2500 platform on a rapid run flow cell using paired-end 125 base pair reads with dual 10 base pair indexes. Upon completion of sequencing, raw data from each Illumina HiSeq run was gathered in local buffer storage and uploaded to the DNAnexus platform (Reid et al., BMC Bioinformatics, 2014, 15, 30) for automated analysis. The FASTQ-formatted reads were converted from the BCL files and assigned to samples identified by specific barcodes using the bcl2fastq conversion software (Illumina Inc., San Diego, CA). All the reads in sample-specific FASTQ files were subject to HLA typing analysis using an updated version of PHLAT program (Bai et al., BMC Genomics, 2014, 15, 325) with the reference sequences consisting of GRCh38 genomic sequences and HLA type reference sequences in the IPD-IMGT/HLA database v3.30.0 (Robinson et al., Hum. Immunol., 2016, 77, 233-237).

In addition, HLA allele imputation was performed following SNP2HLA (Jia et al., PLoS One, 2013, 8, e64683) with the T1DGC HLA allele reference panel (Rich et al., Ann. N.Y. Acad. Sci., 2006, 1079, 1-8). HRC-imputed genotypes in the extended Major Histocompatibility Complex (MHC) region (chr6:25-35 Mb) were filtered for high INFO score (>0.9) and certainty (maximum GP>0.8 for all genotyped), in order to increase overlap with the T1DGC reference panel, were re-phased along with chromosome 6 array genotypes using SHAPEIT4 (Delaneau et al., Nat. Commun., 2019, 10, 5436), and were imputed using Minimac4 (Das et al., Nat. Genet., 2016, 48, 1284-1287). HLA allele imputation quality was assessed by examining INFO score vs MAF, and imputed vs reference panel MAF.

Genetic Association Analyses

Association analyses in each study were performed using the genome-wide Firth logistic regression test implemented in SAIGE (Mbatchou et al., bioRxiv, 2020, 2020.2006.2019.162354, doi:10.1101/2020.06.19.162354; and Zhou et al., Nat. Genet., 2018, 50, 1335-1341). In this implementation, Firth's approach is applied when the p-value from standard logistic regression score test is below 0.05. The directly genotyped variants with a minor allele frequency (MAF)>1%, <10% missingness, Hardy-Weinberg equilibrium test P-value>$10^{-15}$ and linkage-disequilibrium (LD) pruning (1000 variant windows, 100 variant sliding windows and $r^2$<0.1) were included for GRM for SAIGE. The association model included as covariates sex and the first 10 ancestry-informative principal components (PCs) derived from the GRM dataset. Haplotype analyses were performed using PLINK 1.0 (Purcell et al., Am. J. Hum. Genet., 2007, 81, 559-575)-chap and -hap-assoc and -hap-logistic, and in R. High haplotype imputation and phasing quality was indicated by PLINK-hap-phase maximum likelihood haplotype genotypes' posterior probabilities all equal to one.

HLA-A Allele Association Analyses

Association of HLA-A alleles was performed as follows: for each sample, both HLA-A alleles were typed as described above. Following HLA allele typing, related samples were removed. For the remaining cohort of 282 cases and 106 controls, one HLA-A allele that is not A*29 (the "second" allele) was obtained next. Samples carrying two copies of A*29, were considered having A*29 as the second allele. The cohort was then subjected to a Fisher's exact test, which tested the association of each allele that was identified in three or more BSCR cases, with the case-control status. To answer the question of whether the A19 allele group is also associated with the case-control status, the samples were combined, and tested together in two different ways: carrying all Aw19 alleles (A*29, A*30, A*31, A*32 and A*33). Since A*32 is biologically different than the other Aw19 alleles in its peptide binding domain, a group that is made of samples carrying all Aw19 alleles excluding A*32 was also constructed and tested. The final odds-ratios and p-values are presented in the table in FIG. 1.

Example 2: HLA-Aw19 Broad Antigen Serotype Alleles and BSCR Risk

The HLA-A29-controlled cohort allowed for examination of the HLA region while controlling for the strong association of HLA-A29 with BSCR, and therefore to detect possible additional association signals in the HLA region.

First, it was asked whether rare variants on the HLA-A29 background were enriched in BSCR cases. No significant enrichments of rare single or aggregated variants were identified either within or outside the MHC region.

Second, the question was whether other HLA-A alleles in addition to the HLA-A29 allele increased BSCR risk. An assay to type HLA-A alleles in this cohort (see Methods) was constructed, and tested the second HLA-A allele (other than the known first HLA-A29) was tested for association with BSCR. Additional HLA-A alleles were found to be associated with BSCR, and those with the largest effects belonged to the same HLA-Aw19 broad antigen serotype group: HLA-A29:02, A30:02, A31:01 and A33:01 (FIG. 1). As a group, HLA-Aw19 alleles were significantly enriched in the second allele of BSCR patients (OR=4.44, p=2.2e-03, FIG. 2, blue bars). This result suggests, for example, that individuals carrying two copies of HLA-A29 would be at a greater risk of developing BSCR compared to those carrying one copy. It also suggests that other Aw19 allele may play a role in BSCR co-susceptibility or pathogenesis in concert with A29. The sole exception within the HLA-Aw19 sero-type group is HLA-A32, which has been reported not to share the defining Aw19 binding domain (McKenzie et al., Genes Immun., 1999, 1, 120-129); HLA-A32 appears to be depleted in BSCR cases and thus protective against BSCR (OR=0.28, p=0.1).

The above results presented two issues due to the small numbers of controls in UParis (n=108): 1) The frequency of alleles might not represent the frequency of HLA-A alleles in general EUR population. 2) While the high ORs replicate in several HLA-Aw19 alleles, the numbers are not sufficient to support significant associations. To tackle these concerns, the frequency of HLA-A alleles in three other large European (EUR) ancestry control populations, two cohorts from the Geisinger Health System (GHS cohort #1, n=77,198 and GHS cohort #2, n=59,072) and the UK Biobank (UKB, n=463,315) were examined. In all three datasets, the EUR samples carrying at least one HLA-A29 allele were selected, matching the BSCR cohort: 4,014 A29 carriers from GHS cohort #1 (5.2% of all EUR subjects), 2,829 A29 carriers from GHS cohort #2 (4.8% of all EUR), and 38,543 A29 carriers from UKB (8.3% of all EUR). The frequencies of the second HLA-A alleles in these cohorts were compared to those observed in the BSCR cohort (FIG. 2, FIG. 1). The results support the enrichment of four of the five HLA-Aw19 alleles in BSCR cases, with highest increased risk for HLA-A30:02 (GHS cohort #1 OR=4.31, GHS cohort #2

OR=6.6, UKB OR=4.6) and HLA-A33 (GHS cohort #1 OR=3.4, GHS cohort #2 OR=2.8, UKB OR=4.9). When combining samples carrying the four co-susceptibility alleles A29, A30, A31 and A33, was found a highly significant enrichment in BSCR cases was found a when compared with the larger control cohorts (GHS cohort #1 p-val=1.29E-06, GHS cohort #2 p-val=1.07E-06, UKB p-val=9.62E-07, FIG. 1 top row). This analysis excludes A32 because of its biological difference in the sequence of the peptide binding domain as previously reported. The additional analyses with all Aw19 alleles including A32 showed that the enrichment in cases is reduced when it is included (FIG. 1 bottom row).

In order to test whether these associations are affected by measurable confounders, logistic regression tests were conducted to evaluate the effects of the second HLA-A allele in HLA-A29 carriers, in UParis BSCR cases compared with each control cohort, with covariates included for sex and principal components, calculated based on genetic array data for each analytic set (FIG. 3). The results were consistent with increased risk for the HLA-Aw19 co-susceptibility alleles, A29, A30, A31, and A33.

Example 3: HLA-A32 Exhibits Protection from BSCR in an HLA-A29 Positive Cohort HLA-A32 is underrepresented in BSCR cases (3/286, ~1%) versus A29 carrier controls (4/108, 3.7%), corresponding to a nominally significant protection from risk (OR=0.28, p=0.1; FIG. 1). When compared with the larger control cohorts, the trend protection is maintained with both UKB controls (3.4%, OR=0.3, p=0.02) and GHS controls (cohort #1: 3.8%, OR=0.27, p=0.01; cohort #2: 3.7%, OR=0.27, p=0.02). While nominally significant, this result does not pass the threshold of multiple test correction (p=3.57e-03) and will need to be further validated with additional case cohorts.

Example 4: ERAP1 and ERAP2 are Independently Associated with BSCR

All variants and gene burdens were tested for association with case-control status, while controlling for sex and ten principal components, using a generalized linear mixed model (SAIGE). Due to the fact that both cases and controls were A29 allele carriers, the expected strong HLA-A signal was at least partially controlled, as evidenced by the strongest HLA p-value=8.98E-07, compared with p=6.6e-74 with 125 cases in the previous BSCR report (Kuiper et al., Hum. Mol. Genet., 2014, 23, 6081-6087). Overall, no locus passed the genome wide significance threshold (p<5e-8). Other than the remnant signal at HLA-A, only the ERAP1/ERAP2-LNPEP locus on chromosome 5 showed an association with disease at p<1e-6 (FIG. 2).

The top association within the ERAP1/ERAP2-LNPEP locus is the ERAP1 intronic variant rs27432 (OR (95% CI)=2.58 (1.78-3.76), p=6.6e-7), a strong eQTL associated with decreased ERAP1 expression (Kuiper et al., Hum. Mol. Genet., 2018, 27, 4333-4343; and Paladini et al., Sci. Rep., 2018, 8, 10398), which also tags the risk-increasing common ERAP1 haplotype. A haplotype analysis was further performed to assess ERAP1 haplotype associations with BSCR status in the present data. The results were consistent with three levels of risk differentiated by nonsynonymous ERAP1 variant haplotypes corresponding to Kuiper et al. Haps 1+2 (OR=0.41, Cases AF=0.17, controls AF=0.35, p=6.7e-06), Hap10 (OR=1.78, Cases AF=0.28, controls AF=0.17, p=8.0e-03), and haplotypes 3-8 (OR=1.32, Cases AF=0.55, controls AF=0.48, p=0.11) (FIG. 4).

The previously reported top association for BSCR at this locus tags a common variant near ERAP2/LNPEP, rs10044354. This reported risk allele is in a strong linkage disequilibrium (D'=0.99, R²=0.76), with a strong eQTL increasing ERAP2 expression. The results show a nominal association of rs10044354 with increased risk for Birdshot (OR (95% Cl)=1.55 (1.13-2.11), p=5.8e-3). Furthermore, no significant evidence was found for an interaction of rs10044354 with rs27432-rs2287987 haplotypes (conditional haplotype test p=0.46).

Next, a meta-analysis of the results with the published results from Kuiper et al. was carried out, which yielded genome-wide significant associations for both ERAP1 (rs27432, OR (95% Cl)=2.46 (1.85-3.26), p=4.07e-10) and ERAP2 (r510044354, OR (95% Cl)=1.95 (1.55-2.44), p=6.2e-09) loci with BSCR (FIG. 1). Both previous and current studies showed consistent directionality for both variants, which, separated by over 201,222 bp, show low linkage disequilibrium (LD) in the present cohort (R2=0.18, D'=0.79).

The expression of ERAP2 has been previously reported to be disrupted by a common splice region variant (rs2248374, AF=0.53) that causes mis-splicing of intron 10 and eventual transcript degradation via nonsense-mediated decay (Andres et al., PLoS Genet., 2010, 6, e1001157; and Coulombe-Huntington et al., PLoS Genet., 2009, 5, e1000766), and which is in high LD with rs10044354 (R2=0.8, D'=1). Thus, about 25% of the population of most ancestries (including European, AF=0.53; African, AF=0.57 and South Asian, AF=0.58) is estimated to be lacking an active ERAP2 protein. Both datasets were examined for rs2248374 associations and found that it is protective for BSCR with nominal significance in both datasets (FIG. 5). Furthermore, ERAP2-rs2248374 that disrupts ERAP2 expression is protective (OR 0.56; 95% Cl [0.45-0.70]; p=2.39e-07; FIG. 6). In summary, higher expression of ERAP2 protein increases risk for BSCR and a lower expression is protective.

Figure 7:
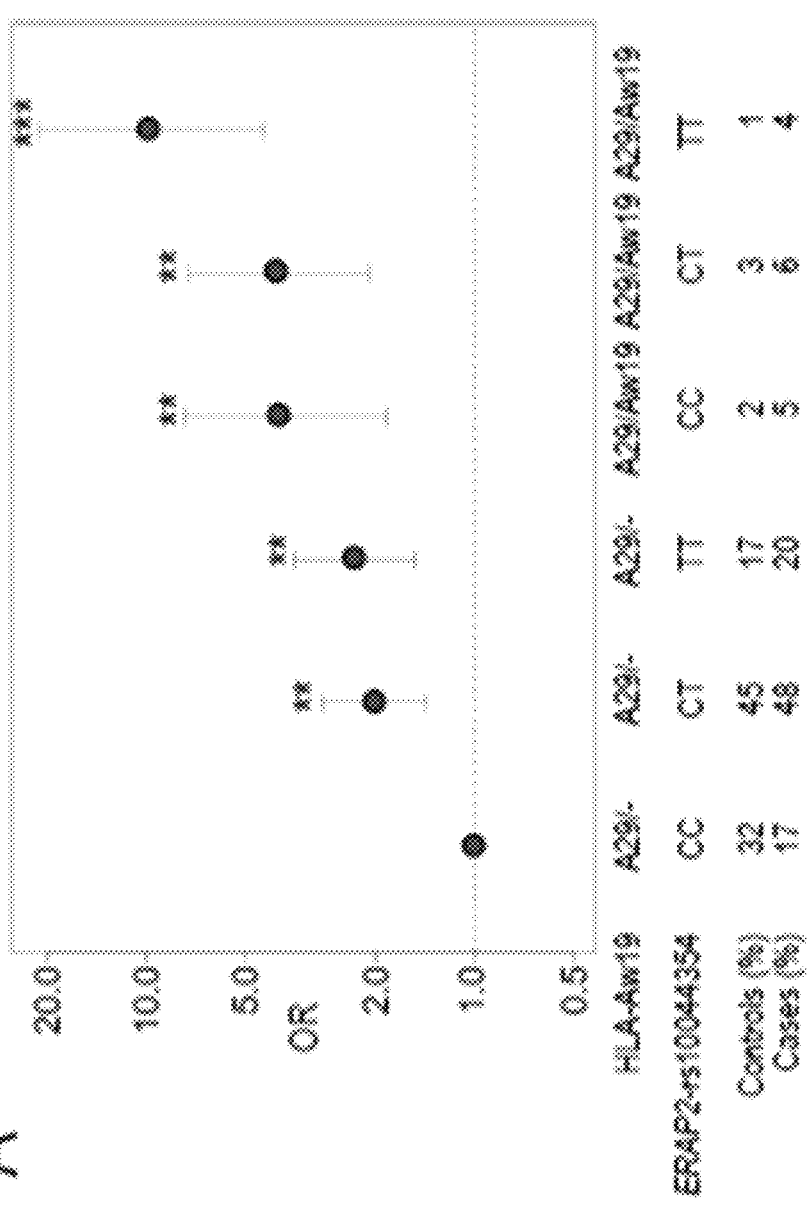
FIG. 7 shows the combined risk of ERAP1, ERAP2 and two copies of Aw19. Utilizing 286 Birdshot cases and 4,014 controls from GHS cohort #1 to calculate additive risk while combining risk factors in ERAP1, ERAP2 and Aw19. Panel A) An additive genotype model of ERAP2 risk signal tagged by rs10044354 and single (A29/-) or double (A29/Aw19) Aw19 copies relative to lowest risk combination of rs10044354-CC and one copy of Aw19 allele (A29). Panel B) An additive genotype model of ERAP1 risk signal tagged by rs27432 and single (A29/-) or double (A29/Aw19) Aw19 copies relative to lowest risk combination of rs27432-AA and one copy of Aw19 allele (A29). Panel C) An additive genotype model of ERAP1 risk signal tagged by rs27432 and ERAP2 signal tagged by rs10044354 relative to lowest risk combination of rs27432-AA and rs10044354-CC. Panel D) An additive genotype model of ERAP1 and ERAP2 risk signals and single (A29/-) or double (A29/Aw19) Aw19 copies relative to lowest risk combination. The genotypes are combined as following: 0=ERAP1 and ERAP2 homozygous for protective allele. 1/[01],[01]/1=either homozygous protective or heterozygous genotypes of both ERAP1 and ERAP2. 2/ . . . /2=homozygous risk allele of either ERAP1 or ERAP2. 2/2=homozygous risk allele of both ERAP1 and ERAP2.
Figure 7:
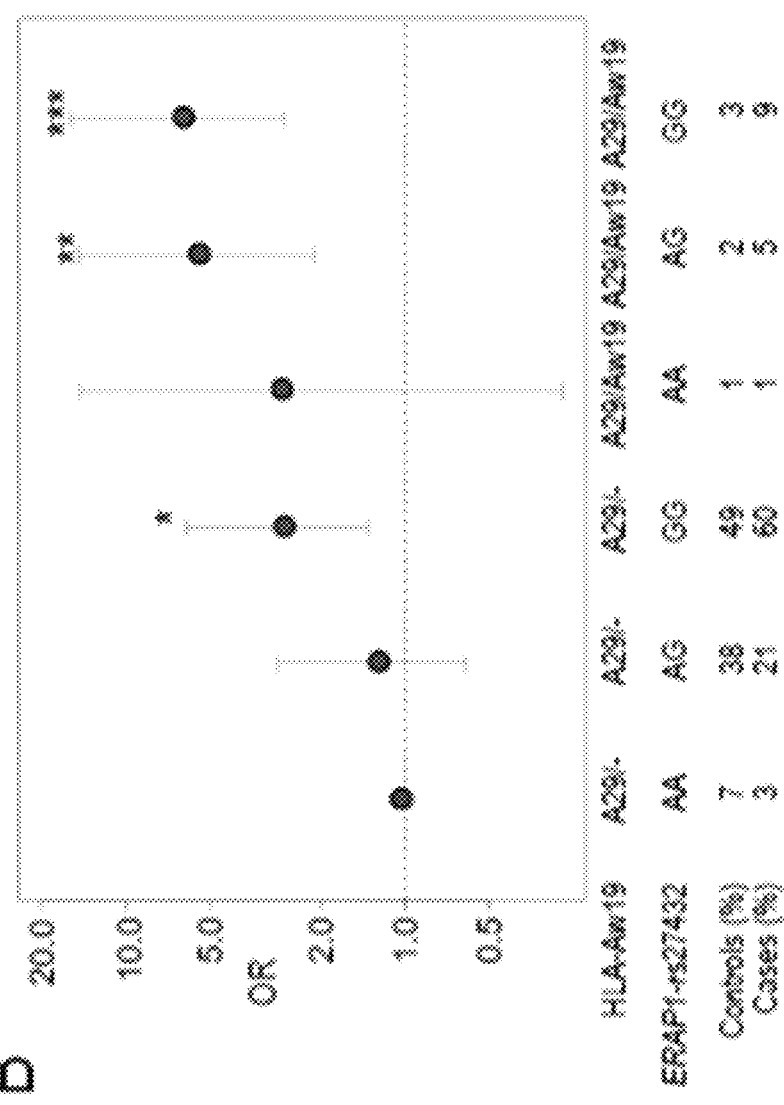
Figure 7:
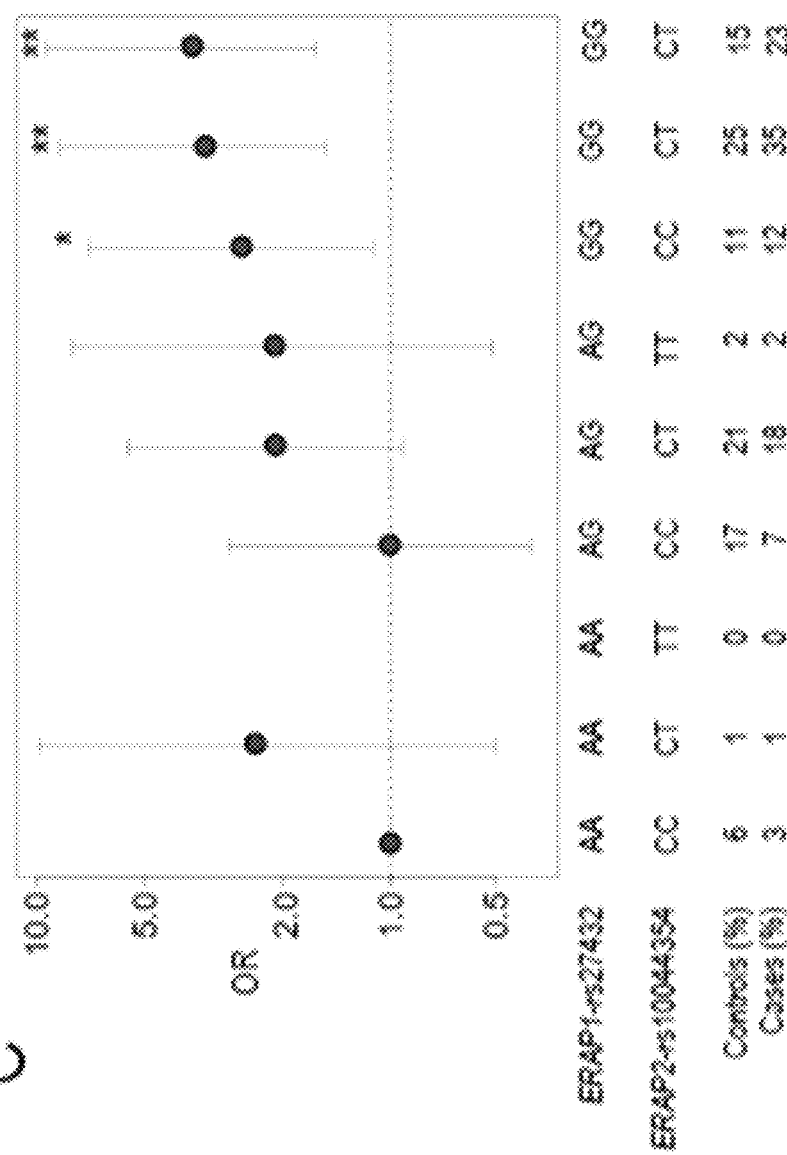
Figure 7:
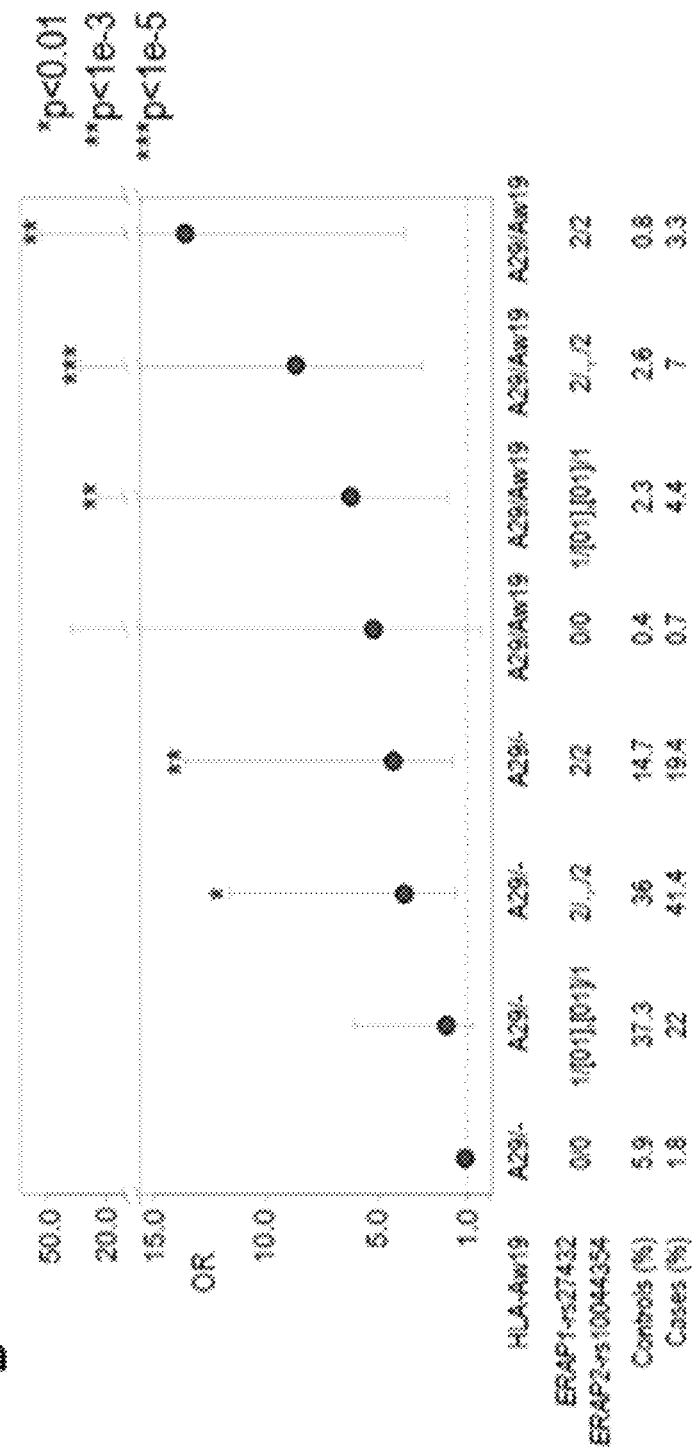

Example 5: Cumulative Effect of HLA-Aw19 Alleles and ERAP1/ERAP2 Haplotypes on BSCR Risk The potential interactions between the ERAP1 and ERAP2 association signals and between HLA-Aw19 and ERAP1/ERAP2 signals was examined by calculating the cumulative effects of HLA-Aw19, ERAP1 and ERAP2 genotypes on BSCR risk using the 286 cases and the 4,014 A29 carriers from the GHS cohort #1. First, an analysis of ERAP2-rs10044354 risk haplotype, the top non-MHC signal in Kuiper et al. was performed, stratified by single (A29/-) versus double (A29/AW19) Aw19 background, which yielded a trend of increased risk with additional ERAP2-rs10044354-T variant alleles, particularly on the double A29/AW19 background (FIG. 7, Panel A). The combination of rs10044354-TT and two copies of Aw19 with 12 cases and 34 controls was found to have the highest risk (OR=9.9 [4.4-21.2], p=1.66e-07, FIG. 8).

A similar analysis of the ERAP1-rs27432 risk haplotype, the top non-MHC association, stratified by single (A29/-) versus double (A29/AW19) Aw19 background, yielded the same trend of increased risk with additional ERAP1-rs27432-G variant alleles, particularly on the double A29/AW19 background (OR=6.2 [2.7-15.51], p=1.54e-06, FIG. 7, Panel B and FIG. 9).

The combined effects of the ERAP1 risk haplotype tagged by rs27432, and the ERAP2 risk haplotype tagged by rs10044354 were calculated next (FIG. 7, Panel C). It was found that the highest risk is conferred by the combination of ERAP1-rs27432-GG and ERAP2-rs10044354-TT (OR=3.6 [1.62-9.45], p=4.03e-04, FIG. 10), and as mentioned above, these data are consistent with additive effects of the variants/haplotypes.

Next, all risk haplotypes were combined to a single risk analysis. Due to the small number of cases, the genotypes of intermediate genotypes were combined into four main groups: 1) homozygous to the protective alleles in both ERAP1 and ERAP2, homozygous in one and 2) heterozygous in the other, 3) homozygous risk allele in either ERAP1 or ERAP2, and 4) homozygous risk allele in both ERAP1 or ERAP2 (FIG. 7, Panel D and FIG. 11). A gradual increase in risk with the addition of each risk allele was observed, with the highest risk presented when carrying homozygous risk alleles in both ERAP1 and ERAP2, on top of two copies of A19 alleles (OR=13.53 [3.79-54.77], p=1.17e-05). These results suggest that both ERAP1 and/or ERAP2 confer greater BSCR risk, which is further increased in the double Aw19 background.

Example 6: Absolute BSCR Risk

The calculation of the absolute risk of BSCR when considering all risk alleles is presented in FIG. 7, Panel D. Since the prevalence of BSCR in general population is estimated at 0.2-1.7:100,000 (Minos et al., Orphanet J. Rare Dis., 2016, 11, 61), 1:100,000 was used as an approximation. The absolute risk was further calculated when carrying one A29 carrier based on the frequency of A29 in UKB EUR population of 8%, and reach an absolute risk of 1:29,000 (FIG. 11). It was observed that the absolute risk climbs with each risk genotype presented in FIG. 7, Panel D, reaching the most prominent risk at 1:2,160 for cases that carry homozygous risk alleles for both ERAP1 and ERAP2, and two copies of Aw19 alleles. Exhibiting a significant increase in absolute risk of disease when carrying all three risk haplotypes.

Example 7: Discussion

The sequencing of a new large BSCR patient cohort and HLA-A*29 controls has confirmed the importance of the ERAP1 and ERAP2 polymorphisms in increasing risk for developing BSCR. ERAP1 and ERAP2 reside back-to-back on chromosome five in opposite orientation and share the regulatory regions, which upregulate one and downregulate the other, and vice versa. The association of both ERAP1 and ERAP2 haplotypes is consistent with a mechanism in which coordinated decreased ERAP1 and increased ERAP2 expression contribute to disease risk. Several studies have reported that the ERAP1 and ERAP2 haplotypes affect their expression as well as the resulting peptidome (Kuiper et al., Hum. Mol. Genet., 2018, 27, 4333-4343; Paladini et al., Sci. Rep., 2018, 8, 10398; and Sanz-Bravo et al., Mol. Cell Proteomics, 2018, 17, 1564-1577).

The present study found that several other HLA-Aw19 family alleles (HLA-A29, A30, A31, A33) contribute additional risk as the second HLA-A allele, in addition to HLA-A29 risk allele. HLA-Aw19 family alleles have a similar antigen-binding sequence and therefore would bind similar peptide motifs. Hence, the enrichment of Aw19 alleles in cases supports the inferred mechanism underlying activation of the immune response in BSCR: having two copies of these alleles may increase the cell-surface presentation of specific types of peptides in BSCR cases compared to HLA-A29 positive controls. Furthermore, it was found that the HLA-A32 allele within the Aw19 family is potentially protective.

These results indicate that a decreased expression of ERAP1 and an increased expression of ERAP2 confer stronger risk for BSCR than each one separately. Furthermore, this effect is increased in the presence of two copies of HLA-Aw19. The combined and additive effect of risk factors associated with peptide processing and presentation is suggestive of a peptide presentation threshold hypothesis as a driving mechanism for the immune response underlying development of BSCR disease. Results from this and other studies suggest that increased ERAP2 along with decreased ERAP1 expression in BSCR cases would lead to higher availability of ERAP2-processed peptides for presentation onto HLA class I proteins. Additional HLA-Aw19 alleles, with similar peptide-binding properties, would increase presentation of similar peptides. Therefore, both the production of a unique peptide pool by dominant ERAP2 activity and the increased expression of HLA-Aw19 risk allele proteins presenting these peptides may increase the likelihood that a putative ocular autoantigen would be processed and presented above a certain threshold to activate an immune response. On the other hand, having lower expression of ERAP2 (and higher expression of ERAP1), along with a single HLA-A*29 allele, lowers the ocular antigenic peptide presentation below the threshold and thus reduces the risk of generating the immunological response leading to BSCR in HLA-A*29 healthy control carriers. This further highlights the importance of the shaping and generation of the available peptide pool by ERAPs to be presented by specific HLA class I proteins in promoting the generation of an immune response or, in the case of autoimmune disease, an aberrant response to a self-antigen.

ERAP1 and ERAP2 polymorphisms and risk haplotypes have also been reported in other HLA class I-associated autoimmune diseases (Babaie et al., Mol. Immunol., 2020, 121, 7-19; and Yao et al., Hum. Immunol., 2019, 80, 325-334). Polymorphisms in ERAP1 increase risk for Ankylosing Spondylitis in HLA-B*27 carriers, for psoriasis vulgaris in HLA-C*06 carriers, and for Behçet's disease in HLA-B*51 carriers, further supporting the combinatorial impact of peptide trimming and HLA class I allele in initiating autoimmune responses (Evans et al., Nat. Genet., 2011, 43, 761-767; Wisniewski et al., Hum. Immunol., 2018, 79, 109-116; Nat. Genet., 2010, 42, 985-990; and Takeuchi et al., Ann. Rheum. Dis., 2016, 75, 2208-2211). Ankylosing Spondylitis and Behçet's disease-associated ERAP1 variants have also been experimentally shown to shape the resulting HLA-B*27 and HLA-B*51 peptidome, respectively (Sanz-Bravo et al., Mol. Cell Proteomics, 2018, 17, 1308-1323; and Guasp et al., J. Biol. Chem., 2017, 292, 9680-9689). Therefore, it is possible that the combination of risk ERAP1/ERAP2 haplotypes and specific risk HLA class I alleles can predispose an individual to develop an HLA class I associated disease in a similar fashion as it is hypothesized for BSCR. This implies that the peptide threshold hypothesis may have broader implications as a disease mechanism in HLA class I associated immunological diseases.

HLA-A32 is the only HLA-Aw19 member that is found at lower rates in BSCR patients compared to controls, suggesting that it could be protective. The HLA-Aw19 serotype was initially identified by antibody binding to related family members; however, this identifies the HLA-A proteins based on structure outside of the peptide-binding groove. Sero-families have since been re-analyzed by overall and peptide binding region sequences (McKenzie et al., Genes Immun. 1999, 1, 120-129). Comparison of the sequences in the peptide binding region reveals that HLA-A32 is more distantly related than the other Aw19 alleles which are identified as novel risk factors in this present study: HLA-A29, A30, A31, A33. When examining the differences in sequence between these Aw19 alleles, two main differences are evident: at position 9, which is part of the peptide binding domain, and a stretch of amino-acids at positions 79-83 that is only found in HLA-A32 and not the other Aw19 alleles (FIG. 12). Theoretically, the peptide pool bound by HLA-A32 would differ from the remaining members of the Aw19 family and would not activate the same subset of responding CD8 T cells. This adds further evidence supporting the hypothesis of the threshold requirement of an increased concentration of the driving autoantigenic peptide pool presented on high-risk HLA-A proteins as a driving component for development of BSCR uveitis.

In summary, the combinatorial impact of ERAP1/2 shaping the immunopeptidome along with differential peptide selection by the key residues in HLA-A29 and HLA-Aw19 family members supports the immunological hypothesis of a peptide pool that is generated by this combination and available for immune cell recognition and activation initiating an inflammatory cascade. Avenues to reduce the expression and recognition of ERAP2-processed and HLA-Aw19-presented peptides in the eye may be beneficial against BSCR disease and/or progression.

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety.

---

SEQUENCE LISTING (5331 sequences)

SEQ ID NO: 1 - RNA, 20 nt, Artificial Sequence
  Description of Artificial Sequence: Synthetic oligonucleotide
aucugccuguuugaguuggg

SEQ ID NO: 2 - RNA, 20 nt, Artificial Sequence
  Description of Artificial Sequence: Synthetic oligonucleotide
uaucugccuguuugaguugg

SEQ ID NO: 3 - RNA, 20 nt, Artificial Sequence
  Description of Artificial Sequence: Synthetic oligonucleotide
uuaucugccuguuugaguug

SEQ ID NO: 4 - RNA, 20 nt, Artificial Sequence
  Description of Artificial Sequence: Synthetic oligonucleotide
cuuuaucugccuguuugagu

SEQ ID NO: 5 - RNA, 20 nt, Artificial Sequence
  Description of Artificial Sequence: Synthetic oligonucleotide
ugaucucucuuuaucugccu

SEQ ID NO: 6 - RNA, 20 nt, Artificial Sequence
  Description of Artificial Sequence: Synthetic oligonucleotide
uugaucucucuuuaucugcc

SEQ ID NO: 7 - RNA, 20 nt, Artificial Sequence
  Description of Artificial Sequence: Synthetic oligonucleotide
ucaugcucaucucuuugauc

SEQ ID NO: 8 - RNA, 20 nt, Artificial Sequence
  Description of Artificial Sequence: Synthetic oligonucleotide
cucaugcucaucucuuugau

SEQ ID NO: 9 - RNA, 20 nt, Artificial Sequence
  Description of Artificial Sequence: Synthetic oligonucleotide
ggacuguaucucaugcucau

SEQ ID NO: 10 - RNA, 20 nt, Artificial Sequence
  Description of Artificial Sequence: Synthetic oligonucleotide
gggacuguaucucaugcuca

SEQ ID NO: 11 - RNA, 20 nt, Artificial Sequence
  Description of Artificial Sequence: Synthetic oligonucleotide
cgggcagcuucugugaucuu

SEQ ID NO: 12 - RNA, 20 nt, Artificial Sequence
  Description of Artificial Sequence: Synthetic oligonucleotide
uuuaaucaaacaccucccgg

SEQ ID NO: 13 - RNA, 20 nt, Artificial Sequence
  Description of Artificial Sequence: Synthetic oligonucleotide
auuuaaucaaacaccucccg

SEQ ID NO: 14 - RNA, 20 nt, Artificial Sequence
  Description of Artificial Sequence: Synthetic oligonucleotide
cuccaguuaugucacauggg

SEQ ID NO: 15 - RNA, 20 nt, Artificial Sequence
  Description of Artificial Sequence: Synthetic oligonucleotide
ggcuccaguuaugucacaug

SEQ ID NO: 16 - RNA, 20 nt, Artificial Sequence
  Description of Artificial Sequence: Synthetic oligonucleotide
cuggcuccaguuaugucaca

SEQ ID NO: 17 - RNA, 20 nt, Artificial Sequence
  Description of Artificial Sequence: Synthetic oligonucleotide
aguucuucauggcacugcac

SEQ ID NO: 18 - RNA, 20 nt, Artificial Sequence
  Description of Artificial Sequence: Synthetic oligonucleotide
uaguucuucauggcacugca

SEQ ID NO: 19 - RNA, 20 nt, Artificial Sequence
  Description of Artificial Sequence: Synthetic oligonucleotide
agacaaguuaauauccaggc

SEQ ID NO: 20 - RNA, 20 nt, Artificial Sequence
  Description of Artificial Sequence: Synthetic oligonucleotide
gcagaagaauggaacaugaa

SEQ ID NO: 21 - RNA, 20 nt, Artificial Sequence
  Description of Artificial Sequence: Synthetic oligonucleotide
gugugaauuaaccauugcag

SEQ ID NO: 22 - RNA, 20 nt, Artificial Sequence
  Description of Artificial Sequence: Synthetic oligonucleotide
cugugugaauuaaccauugc

SEQ ID NO: 23 - RNA, 20 nt, Artificial Sequence
  Description of Artificial Sequence: Synthetic oligonucleotide
agcaguaaaauccucuguga

SEQ ID NO: 24 - RNA, 20 nt, Artificial Sequence
  Description of Artificial Sequence: Synthetic oligonucleotide
aagcaguaaaauccucugug

SEQ ID NO: 25 - RNA, 20 nt, Artificial Sequence
  Description of Artificial Sequence: Synthetic oligonucleotide
ggcuguuaagcaguaaaauc

SEQ ID NO: 26 - RNA, 20 nt, Artificial Sequence
  Description of Artificial Sequence: Synthetic oligonucleotide
gauggcuguuaagcaguaaa

SEQ ID NO: 27 - RNA, 20 nt, Artificial Sequence
  Description of Artificial Sequence: Synthetic oligonucleotide
aagauggcuguuaagcagua

SEQ ID NO: 28 - RNA, 20 nt, Artificial Sequence
  Description of Artificial Sequence: Synthetic oligonucleotide
caagauggcuguuaagcagu

SEQ ID NO: 29 - RNA, 20 nt, Artificial Sequence
  Description of Artificial Sequence: Synthetic oligonucleotide
cacugagaacugagaacaaa

SEQ ID NO: 30 - RNA, 20 nt, Artificial Sequence
  Description of Artificial Sequence: Synthetic oligonucleotide
auggcacugagaacugagaa

SEQ ID NO: 31 - RNA, 20 nt, Artificial Sequence
  Description of Artificial Sequence: Synthetic oligonucleotide
gauggcacugagaacugaga

SEQ ID NO: 32 - RNA, 20 nt, Artificial Sequence
  Description of Artificial Sequence: Synthetic oligonucleotide
uagauggcacugagaacuga

SEQ ID NO: 33 - RNA, 20 nt, Artificial Sequence
  Description of Artificial Sequence: Synthetic oligonucleotide
cuagauggcacugagaacug

SEQ ID NO: 34 - RNA, 20 nt, Artificial Sequence
  Description of Artificial Sequence: Synthetic oligonucleotide
gauaacuagauggcacugag

SEQ ID NO: 35 - RNA, 20 nt, Artificial Sequence
  Description of Artificial Sequence: Synthetic oligonucleotide
ugauaacuagauggcacuga

SEQ ID NO: 36 - RNA, 20 nt, Artificial Sequence
  Description of Artificial Sequence: Synthetic oligonucleotide
gugauaacuagauggcacug

SEQ ID NO: 37 - RNA, 20 nt, Artificial Sequence
  Description of Artificial Sequence: Synthetic oligonucleotide
gaagugauaacuagauggca

SEQ ID NO: 38 - RNA, 20 nt, Artificial Sequence
  Description of Artificial Sequence: Synthetic oligonucleotide
ugaagugauaacuagauggc

SEQ ID NO: 39 - RNA, 20 nt, Artificial Sequence
  Description of Artificial Sequence: Synthetic oligonucleotide
gugaagugauaacuagaugg

SEQ ID NO: 40 - RNA, 20 nt, Artificial Sequence
  Description of Artificial Sequence: Synthetic oligonucleotide
cucagugaagugauaacuag

SEQ ID NO: 41 - RNA, 20 nt, Artificial Sequence
  Description of Artificial Sequence: Synthetic oligonucleotide
ccucagugaagugauaacua

SEQ ID NO: 42 - RNA, 20 nt, Artificial Sequence
  Description of Artificial Sequence: Synthetic oligonucleotide
uccucagugaagugauaacu

SEQ ID NO: 43 - RNA, 20 nt, Artificial Sequence
  Description of Artificial Sequence: Synthetic oligonucleotide
gauccucagugaagugauaa

SEQ ID NO: 44 - RNA, 20 nt, Artificial Sequence
  Description of Artificial Sequence: Synthetic oligonucleotide
uuaguggcuacugggaaagc

SEQ ID NO: 45 - RNA, 20 nt, Artificial Sequence
  Description of Artificial Sequence: Synthetic oligonucleotide
auuaguggcuacugggaaag

SEQ ID NO: 46 - RNA, 20 nt, Artificial Sequence
  Description of Artificial Sequence: Synthetic oligonucleotide
cauuaguggcuacugggaaa

SEQ ID NO: 47 - RNA, 20 nt, Artificial Sequence
  Description of Artificial Sequence: Synthetic oligonucleotide
ccauuaguggcuacugggaa

SEQ ID NO: 48 - RNA, 20 nt, Artificial Sequence
  Description of Artificial Sequence: Synthetic oligonucleotide
aucuuaaaucaugcugcugc

SEQ ID NO: 49 - RNA, 20 nt, Artificial Sequence
  Description of Artificial Sequence: Synthetic oligonucleotide
cuccaguuaugucacauggg

SEQ ID NO: 50 - RNA, 20 nt, Artificial Sequence
  Description of Artificial Sequence: Synthetic oligonucleotide
ggcuccaguuaugucacaug

SEQ ID NO: 51 - RNA, 20 nt, Artificial Sequence
  Description of Artificial Sequence: Synthetic oligonucleotide
cuggcuccaguuaugucaca

SEQ ID NO: 52 - RNA, 20 nt, Artificial Sequence
  Description of Artificial Sequence: Synthetic oligonucleotide
aguucuucauggcacugcac

SEQ ID NO: 53 - RNA, 20 nt, Artificial Sequence
  Description of Artificial Sequence: Synthetic oligonucleotide
uaguucuucauggcacugca

SEQ ID NO: 54 - RNA, 20 nt, Artificial Sequence
  Description of Artificial Sequence: Synthetic oligonucleotide
agacaaguuaauauccaggc

SEQ ID NO: 55 - RNA, 20 nt, Artificial Sequence
  Description of Artificial Sequence: Synthetic oligonucleotide
gcagaagaauggaacaugaa

SEQ ID NO: 56 - RNA, 20 nt, Artificial Sequence
  Description of Artificial Sequence: Synthetic oligonucleotide
gugugaauuaaccauugcag

SEQ ID NO: 57 - RNA, 20 nt, Artificial Sequence
  Description of Artificial Sequence: Synthetic oligonucleotide
cugugugaauuaaccauugc

SEQ ID NO: 58 - RNA, 20 nt, Artificial Sequence
  Description of Artificial Sequence: Synthetic oligonucleotide
agcaguaaaauccucuguga

SEQ ID NO: 59 - RNA, 20 nt, Artificial Sequence
  Description of Artificial Sequence: Synthetic oligonucleotide
aagcaguaaaauccucugug

SEQ ID NO: 60 - RNA, 20 nt, Artificial Sequence
  Description of Artificial Sequence: Synthetic oligonucleotide
ggcuguuaagcaguaaaauc

SEQ ID NO: 61 - RNA, 20 nt, Artificial Sequence
  Description of Artificial Sequence: Synthetic oligonucleotide
gauggcuguuaagcaguaaa

SEQ ID NO: 62 - RNA, 20 nt, Artificial Sequence
  Description of Artificial Sequence: Synthetic oligonucleotide
aagauggcuguuaagcagua

SEQ ID NO: 63 - RNA, 20 nt, Artificial Sequence
  Description of Artificial Sequence: Synthetic oligonucleotide
caagauggcuguuaagcagu

SEQ ID NO: 64 - RNA, 20 nt, Artificial Sequence
  Description of Artificial Sequence: Synthetic oligonucleotide
cacugagaacugagaacaaa

SEQ ID NO: 65 - RNA, 20 nt, Artificial Sequence
  Description of Artificial Sequence: Synthetic oligonucleotide
auggcacugagaacugagaa

SEQ ID NO: 66 - RNA, 20 nt, Artificial Sequence
  Description of Artificial Sequence: Synthetic oligonucleotide
gauggcacugagaacugaga

SEQ ID NO: 67 - RNA, 20 nt, Artificial Sequence
  Description of Artificial Sequence: Synthetic oligonucleotide
uagauggcacugagaacuga

SEQ ID NO: 68 - RNA, 20 nt, Artificial Sequence
  Description of Artificial Sequence: Synthetic oligonucleotide
cuagauggcacugagaacug

SEQ ID NO: 69 - RNA, 20 nt, Artificial Sequence
  Description of Artificial Sequence: Synthetic oligonucleotide
gauaacuagauggcacugag

SEQ ID NO: 70 - RNA, 20 nt, Artificial Sequence
  Description of Artificial Sequence: Synthetic oligonucleotide
ugauaacuagauggcacuga

SEQ ID NO: 71 - RNA, 20 nt, Artificial Sequence
  Description of Artificial Sequence: Synthetic oligonucleotide
gugauaacuagauggcacug

SEQ ID NO: 72 - RNA, 20 nt, Artificial Sequence
  Description of Artificial Sequence: Synthetic oligonucleotide
gaagugauaacuagauggca

SEQ ID NO: 73 - RNA, 20 nt, Artificial Sequence
  Description of Artificial Sequence: Synthetic oligonucleotide
ugaagugauaacuagauggc

SEQ ID NO: 74 - RNA, 20 nt, Artificial Sequence
  Description of Artificial Sequence: Synthetic oligonucleotide
gugaagugauaacuagaugg

SEQ ID NO: 75 - RNA, 20 nt, Artificial Sequence
  Description of Artificial Sequence: Synthetic oligonucleotide
cucagugaagugauaacuag

SEQ ID NO: 76 - RNA, 20 nt, Artificial Sequence
  Description of Artificial Sequence: Synthetic oligonucleotide
ccucagugaagugauaacua

SEQ ID NO: 77 - RNA, 20 nt, Artificial Sequence
  Description of Artificial Sequence: Synthetic oligonucleotide
uccucagugaagugauaacu

SEQ ID NO: 78 - RNA, 20 nt, Artificial Sequence
  Description of Artificial Sequence: Synthetic oligonucleotide
gauccucagugaagugauaa

SEQ ID NO: 79 - RNA, 20 nt, Artificial Sequence
  Description of Artificial Sequence: Synthetic oligonucleotide
uuaguggcuacugggaaagc

SEQ ID NO: 80 - RNA, 20 nt, Artificial Sequence
  Description of Artificial Sequence: Synthetic oligonucleotide
auuaguggcuacugggaaag

SEQ ID NO: 81 - RNA, 20 nt, Artificial Sequence
  Description of Artificial Sequence: Synthetic oligonucleotide
cauuaguggcuacugggaaa

SEQ ID NO: 82 - RNA, 20 nt, Artificial Sequence
  Description of Artificial Sequence: Synthetic oligonucleotide
ccauuaguggcuacugggaa

SEQ ID NO: 83 - RNA, 20 nt, Artificial Sequence
  Description of Artificial Sequence: Synthetic oligonucleotide
uaauggagaggaaugaccac

SEQ ID NO: 84 - RNA, 20 nt, Artificial Sequence
  Description of Artificial Sequence: Synthetic oligonucleotide
auaauggagaggaaugacca

SEQ ID NO: 85 - RNA, 20 nt, Artificial Sequence
  Description of Artificial Sequence: Synthetic oligonucleotide
agaggucauaauggagagga

SEQ ID NO: 86 - RNA, 20 nt, Artificial Sequence
  Description of Artificial Sequence: Synthetic oligonucleotide
aagaggucauaauggagagg

SEQ ID NO: 87 - RNA, 20 nt, Artificial Sequence
  Description of Artificial Sequence: Synthetic oligonucleotide
aaagaggucauaauggagag

SEQ ID NO: 88 - RNA, 20 nt, Artificial Sequence
  Description of Artificial Sequence: Synthetic oligonucleotide
caaagaggucauaauggaga

SEQ ID NO: 89 - RNA, 20 nt, Artificial Sequence
  Description of Artificial Sequence: Synthetic oligonucleotide
acaaagaggucauaauggag

SEQ ID NO: 90 - RNA, 20 nt, Artificial Sequence
  Description of Artificial Sequence: Synthetic oligonucleotide
ggacaaagaggucauaaugg

SEQ ID NO: 91 - RNA, 20 nt, Artificial Sequence
  Description of Artificial Sequence: Synthetic oligonucleotide
aaaguccagagaggugagau

SEQ ID NO: 92 - RNA, 20 nt, Artificial Sequence
  Description of Artificial Sequence: Synthetic oligonucleotide
caaaguccagagaggugaga

SEQ ID NO: 93 - RNA, 20 nt, Artificial Sequence
  Description of Artificial Sequence: Synthetic oligonucleotide
augcaacaaaguccagagag

SEQ ID NO: 94 - RNA, 20 nt, Artificial Sequence
  Description of Artificial Sequence: Synthetic oligonucleotide
gaugcaacaaaguccagaga

SEQ ID NO: 95 - RNA, 20 nt, Artificial Sequence
  Description of Artificial Sequence: Synthetic oligonucleotide
agaugcaacaaaguccagag

SEQ ID NO: 96 - RNA, 20 nt, Artificial Sequence
  Description of Artificial Sequence: Synthetic oligonucleotide
cucagaugcaacaaagucca

SEQ ID NO: 97 - RNA, 20 nt, Artificial Sequence
  Description of Artificial Sequence: Synthetic oligonucleotide
uucucagaugcaacaaaguc

SEQ ID NO: 98 - RNA, 20 nt, Artificial Sequence
  Description of Artificial Sequence: Synthetic oligonucleotide
cuucucagaugcaacaaagu

SEQ ID NO: 99 - RNA, 20 nt, Artificial Sequence
  Description of Artificial Sequence: Synthetic oligonucleotide
agcauugcugaccaagacuu

SEQ ID NO: 100 - RNA, 20 nt, Artificial Sequence
  Description of Artificial Sequence: Synthetic oligonucleotide
uagcauugcugaccaagacu

SEQ ID NO: 101 - RNA, 20 nt, Artificial Sequence
  Description of Artificial Sequence: Synthetic oligonucleotide
guagcauugcugaccaagac

SEQ ID NO: 102 - RNA, 20 nt, Artificial Sequence
  Description of Artificial Sequence: Synthetic oligonucleotide
gguagcauugcugaccaaga

SEQ ID NO: 103 - RNA, 20 nt, Artificial Sequence
  Description of Artificial Sequence: Synthetic oligonucleotide
ggguagcauugcugaccaag

SEQ ID NO: 104 - RNA, 20 nt, Artificial Sequence
  Description of Artificial Sequence: Synthetic oligonucleotide
uggguagcauugcugaccaa

SEQ ID NO: 105 - RNA, 20 nt, Artificial Sequence
  Description of Artificial Sequence: Synthetic oligonucleotide
aaacuggguagcauugcuga

SEQ ID NO: 106 - RNA, 20 nt, Artificial Sequence
  Description of Artificial Sequence: Synthetic oligonucleotide
uaaacuggguagcauugcug

SEQ ID NO: 107 - RNA, 20 nt, Artificial Sequence
  Description of Artificial Sequence: Synthetic oligonucleotide
ugauaaacuggguagcauug

SEQ ID NO: 108 - RNA, 20 nt, Artificial Sequence
  Description of Artificial Sequence: Synthetic oligonucleotide
agaugauaaacuggguagca

SEQ ID NO: 109 - RNA, 20 nt, Artificial Sequence
  Description of Artificial Sequence: Synthetic oligonucleotide
aagaugauaaacuggguagc

SEQ ID NO: 110 - RNA, 20 nt, Artificial Sequence
  Description of Artificial Sequence: Synthetic oligonucleotide
caagaugauaaacuggguag

SEQ ID NO: 111 - RNA, 20 nt, Artificial Sequence
  Description of Artificial Sequence: Synthetic oligonucleotide
gcaagaugauaaacugggua

SEQ ID NO: 112 - RNA, 20 nt, Artificial Sequence
  Description of Artificial Sequence: Synthetic oligonucleotide
gugcaagaugauaaacuggg

SEQ ID NO: 113 - RNA, 20 nt, Artificial Sequence
  Description of Artificial Sequence: Synthetic oligonucleotide
ugugcaagaugauaaacugg

SEQ ID NO: 114 - RNA, 20 nt, Artificial Sequence
  Description of Artificial Sequence: Synthetic oligonucleotide
cugugcaagaugauaaacug

SEQ ID NO: 115 - RNA, 20 nt, Artificial Sequence
  Description of Artificial Sequence: Synthetic oligonucleotide
gcugugcaagaugauaaacu

SEQ ID NO: 116 - RNA, 20 nt, Artificial Sequence
  Description of Artificial Sequence: Synthetic oligonucleotide
ggcauucgugauuucaagau

SEQ ID NO: 117 - RNA, 20 nt, Artificial Sequence
  Description of Artificial Sequence: Synthetic oligonucleotide
uggcauucgugauuucaaga

SEQ ID NO: 118 - RNA, 20 nt, Artificial Sequence
  Description of Artificial Sequence: Synthetic oligonucleotide
guggcauucgugauuucaag

SEQ ID NO: 119 - RNA, 20 nt, Artificial Sequence
  Description of Artificial Sequence: Synthetic oligonucleotide
gguggcauucgugauuucaa

SEQ ID NO: 120 - RNA, 20 nt, Artificial Sequence
  Description of Artificial Sequence: Synthetic oligonucleotide
ggguggcauucgugauuuca

SEQ ID NO: 121 - RNA, 20 nt, Artificial Sequence
  Description of Artificial Sequence: Synthetic oligonucleotide
aggguggcauucgugauuuc

SEQ ID NO: 122 - RNA, 20 nt, Artificial Sequence
  Description of Artificial Sequence: Synthetic oligonucleotide
aaggguggcauucgugauuu

SEQ ID NO: 123 - RNA, 20 nt, Artificial Sequence
  Description of Artificial Sequence: Synthetic oligonucleotide
cugaaggguggcauucguga

SEQ ID NO: 124 - RNA, 20 nt, Artificial Sequence
  Description of Artificial Sequence: Synthetic oligonucleotide
acugaaggguggcauucgug

SEQ ID NO: 125 - RNA, 20 nt, Artificial Sequence
  Description of Artificial Sequence: Synthetic oligonucleotide
gacugaaggguggcauucgu

SEQ ID NO: 126 - RNA, 20 nt, Artificial Sequence
  Description of Artificial Sequence: Synthetic oligonucleotide
ugacugaaggguggcauucg

SEQ ID NO: 127 - RNA, 20 nt, Artificial Sequence
  Description of Artificial Sequence: Synthetic oligonucleotide
cugacugaaggguggcauuc

SEQ ID NO: 128 - RNA, 20 nt, Artificial Sequence
  Description of Artificial Sequence: Synthetic oligonucleotide
ucugacugaaggguggcauu

SEQ ID NO: 129 - RNA, 20 nt, Artificial Sequence
  Description of Artificial Sequence: Synthetic oligonucleotide
cucugacugaaggguggcau

SEQ ID NO: 130 - RNA, 20 nt, Artificial Sequence
  Description of Artificial Sequence: Synthetic oligonucleotide
ccucugacugaaggguggca

SEQ ID NO: 131 - RNA, 20 nt, Artificial Sequence
  Description of Artificial Sequence: Synthetic oligonucleotide
uccucugacugaaggguggc

SEQ ID NO: 132 - RNA, 20 nt, Artificial Sequence
  Description of Artificial Sequence: Synthetic oligonucleotide
uuccucugacugaagggugg

SEQ ID NO: 133 - RNA, 20 nt, Artificial Sequence
  Description of Artificial Sequence: Synthetic oligonucleotide
uugaaucuuccucugacuga

SEQ ID NO: 134 - RNA, 20 nt, Artificial Sequence
  Description of Artificial Sequence: Synthetic oligonucleotide
cuugaaucuuccucugacug

SEQ ID NO: 135 - RNA, 20 nt, Artificial Sequence
  Description of Artificial Sequence: Synthetic oligonucleotide
ucuugaaucuuccucugacu

SEQ ID NO: 136 - RNA, 20 nt, Artificial Sequence
  Description of Artificial Sequence: Synthetic oligonucleotide
guaucuugaaucuuccucug

SEQ ID NO: 137 - RNA, 20 nt, Artificial Sequence
  Description of Artificial Sequence: Synthetic oligonucleotide
uccugguuucauguaucuug

SEQ ID NO: 138 - RNA, 20 nt, Artificial Sequence
  Description of Artificial Sequence: Synthetic oligonucleotide
gcaggguaacucaaaacuuu

SEQ ID NO: 139 - RNA, 20 nt, Artificial Sequence
  Description of Artificial Sequence: Synthetic oligonucleotide
agcaggguaacucaaaacuu

SEQ ID NO: 140 - RNA, 20 nt, Artificial Sequence
  Description of Artificial Sequence: Synthetic oligonucleotide
gagcaggguaacucaaaacu

SEQ ID NO: 141 - RNA, 20 nt, Artificial Sequence
  Description of Artificial Sequence: Synthetic oligonucleotide
agcagugcaauuuguucaug

SEQ ID NO: 142 - RNA, 20 nt, Artificial Sequence
  Description of Artificial Sequence: Synthetic oligonucleotide
cagcagugcaauuuguucau

SEQ ID NO: 143 - RNA, 20 nt, Artificial Sequence
  Description of Artificial Sequence: Synthetic oligonucleotide
ccagcagugcaauuuguuca

SEQ ID NO: 144 - RNA, 20 nt, Artificial Sequence
  Description of Artificial Sequence: Synthetic oligonucleotide
accagcagugcaauuuguuc

SEQ ID NO: 145 - RNA, 20 nt, Artificial Sequence
  Description of Artificial Sequence: Synthetic oligonucleotide
aaccagcagugcaauuuguu

SEQ ID NO: 146 - RNA, 20 nt, Artificial Sequence
  Description of Artificial Sequence: Synthetic oligonucleotide
gaaccagcagugcaauuugu

SEQ ID NO: 147 - RNA, 20 nt, Artificial Sequence
  Description of Artificial Sequence: Synthetic oligonucleotide
ggaaccagcagugcaauuug

SEQ ID NO: 148 - RNA, 20 nt, Artificial Sequence
  Description of Artificial Sequence: Synthetic oligonucleotide
ucuggaaccagcagugcaau

SEQ ID NO: 149 - RNA, 20 nt, Artificial Sequence
  Description of Artificial Sequence: Synthetic oligonucleotide
ucucuggaaccagcagugca

SEQ ID NO: 150 - RNA, 20 nt, Artificial Sequence
  Description of Artificial Sequence: Synthetic oligonucleotide
uucucuggaaccagcagugc

SEQ ID NO: 151 - RNA, 20 nt, Artificial Sequence
  Description of Artificial Sequence: Synthetic oligonucleotide
uuucucuggaaccagcagug

SEQ ID NO: 152 - RNA, 20 nt, Artificial Sequence
  Description of Artificial Sequence: Synthetic oligonucleotide
cguaaguuucucuggaacca

SEQ ID NO: 153 - RNA, 20 nt, Artificial Sequence
  Description of Artificial Sequence: Synthetic oligonucleotide
gcguaaguuucucuggaacc

SEQ ID NO: 154 - RNA, 20 nt, Artificial Sequence
  Description of Artificial Sequence: Synthetic oligonucleotide
ggcguaaguuucucuggaac

SEQ ID NO: 155 - RNA, 20 nt, Artificial Sequence
  Description of Artificial Sequence: Synthetic oligonucleotide
aggcguaaguuucucuggaa

SEQ ID NO: 156 - RNA, 20 nt, Artificial Sequence
  Description of Artificial Sequence: Synthetic oligonucleotide
gaggcguaaguuucucugga

SEQ ID NO: 157 - RNA, 20 nt, Artificial Sequence
  Description of Artificial Sequence: Synthetic oligonucleotide
ugaggcguaaguuucucugg

SEQ ID NO: 158 - RNA, 20 nt, Artificial Sequence
  Description of Artificial Sequence: Synthetic oligonucleotide
gugaggcguaaguuucucug

SEQ ID NO: 159 - RNA, 20 nt, Artificial Sequence
  Description of Artificial Sequence: Synthetic oligonucleotide
ggugaggcguaaguuucucu

SEQ ID NO: 160 - RNA, 20 nt, Artificial Sequence
  Description of Artificial Sequence: Synthetic oligonucleotide
aggugaggcguaaguuucuc

SEQ ID NO: 161 - RNA, 20 nt, Artificial Sequence
  Description of Artificial Sequence: Synthetic oligonucleotide
caggugaggcguaaguuucu

SEQ ID NO: 162 - RNA, 20 nt, Artificial Sequence
  Description of Artificial Sequence: Synthetic oligonucleotide
ucaggugaggcguaaguuuc

SEQ ID NO: 163 - RNA, 20 nt, Artificial Sequence
  Description of Artificial Sequence: Synthetic oligonucleotide
uucaggugaggcguaaguuu

SEQ ID NO: 164 - RNA, 20 nt, Artificial Sequence
  Description of Artificial Sequence: Synthetic oligonucleotide
uuucaggugaggcguaaguu

SEQ ID NO: 165 - RNA, 20 nt, Artificial Sequence
  Description of Artificial Sequence: Synthetic oligonucleotide
auuucaggugaggcguaagu

SEQ ID NO: 166 - RNA, 20 nt, Artificial Sequence
  Description of Artificial Sequence: Synthetic oligonucleotide
uauuucaggugaggcguaag

SEQ ID NO: 167 - RNA, 20 nt, Artificial Sequence
  Description of Artificial Sequence: Synthetic oligonucleotide
guauuucaggugaggcguaa

SEQ ID NO: 168 - RNA, 20 nt, Artificial Sequence
  Description of Artificial Sequence: Synthetic oligonucleotide
aguauuucaggugaggcgua

SEQ ID NO: 169 - RNA, 20 nt, Artificial Sequence
  Description of Artificial Sequence: Synthetic oligonucleotide
auaguauuucaggugaggcg

SEQ ID NO: 170 - RNA, 20 nt, Artificial Sequence
  Description of Artificial Sequence: Synthetic oligonucleotide
cauaguauuucaggugaggc

SEQ ID NO: 171 - RNA, 20 nt, Artificial Sequence
  Description of Artificial Sequence: Synthetic oligonucleotide
cacauaguauuucaggugag

SEQ ID NO: 172 - RNA, 20 nt, Artificial Sequence
  Description of Artificial Sequence: Synthetic oligonucleotide
agccacauaguauuucaggu

SEQ ID NO: 173 - RNA, 20 nt, Artificial Sequence
  Description of Artificial Sequence: Synthetic oligonucleotide
uagccacauaguauuucagg

SEQ ID NO: 174 - RNA, 20 nt, Artificial Sequence
  Description of Artificial Sequence: Synthetic oligonucleotide
ccauagccacauaguauuuc

SEQ ID NO: 175 - RNA, 20 nt, Artificial Sequence
  Description of Artificial Sequence: Synthetic oligonucleotide
aguccauagccacauaguau

SEQ ID NO: 176 - RNA, 20 nt, Artificial Sequence
  Description of Artificial Sequence: Synthetic oligonucleotide
aaguccauagccacauagua

SEQ ID NO: 177 - RNA, 20 nt, Artificial Sequence
  Description of Artificial Sequence: Synthetic oligonucleotide
gaaguccauagccacauagu

SEQ ID NO: 178 - RNA, 20 nt, Artificial Sequence
  Description of Artificial Sequence: Synthetic oligonucleotide
ggaaguccauagccacauag

SEQ ID NO: 179 - RNA, 20 nt, Artificial Sequence
  Description of Artificial Sequence: Synthetic oligonucleotide
uggaaguccauagccacaua

SEQ ID NO: 180 - RNA, 20 nt, Artificial Sequence
  Description of Artificial Sequence: Synthetic oligonucleotide
gcuuggaaguccauagccac

SEQ ID NO: 181 - RNA, 20 nt, Artificial Sequence
  Description of Artificial Sequence: Synthetic oligonucleotide
uuggcuuggaaguccauagc

SEQ ID NO: 182 - RNA, 20 nt, Artificial Sequence
  Description of Artificial Sequence: Synthetic oligonucleotide
caccuaacuuggcuuggaag

SEQ ID NO: 183 - RNA, 20 nt, Artificial Sequence
  Description of Artificial Sequence: Synthetic oligonucleotide
aucaccuaacuuggcuugga

SEQ ID NO: 184 - RNA, 20 nt, Artificial Sequence
  Description of Artificial Sequence: Synthetic oligonucleotide
caucaccuaacuuggcuugg

SEQ ID NO: 185 - RNA, 20 nt, Artificial Sequence
  Description of Artificial Sequence: Synthetic oligonucleotide
ccaucaccuaacuuggcuug

SEQ ID NO: 186 - RNA, 20 nt, Artificial Sequence
  Description of Artificial Sequence: Synthetic oligonucleotide
caaagccaucaccuaacuug

SEQ ID NO: 187 - RNA, 20 nt, Artificial Sequence
  Description of Artificial Sequence: Synthetic oligonucleotide
ucaaagccaucaccuaacuu

SEQ ID NO: 188 - RNA, 20 nt, Artificial Sequence
  Description of Artificial Sequence: Synthetic oligonucleotide
uucaaagccaucaccuaacu

SEQ ID NO: 189 - RNA, 20 nt, Artificial Sequence
  Description of Artificial Sequence: Synthetic oligonucleotide
cuucaaagccaucaccuaac

SEQ ID NO: 190 - RNA, 20 nt, Artificial Sequence
  Description of Artificial Sequence: Synthetic oligonucleotide
acccuucaaagccaucaccu

SEQ ID NO: 191 - RNA, 20 nt, Artificial Sequence
  Description of Artificial Sequence: Synthetic oligonucleotide
aacccuucaaagccaucacc

SEQ ID NO: 192 - RNA, 20 nt, Artificial Sequence
  Description of Artificial Sequence: Synthetic oligonucleotide
caagaguucuguaugugcuu

SEQ ID NO: 193 - RNA, 20 nt, Artificial Sequence
  Description of Artificial Sequence: Synthetic oligonucleotide
ccaagaguucuguaugugcu

SEQ ID NO: 194 - RNA, 20 nt, Artificial Sequence
  Description of Artificial Sequence: Synthetic oligonucleotide
accaagaguucuguaugugc

SEQ ID NO: 195 - RNA, 20 nt, Artificial Sequence
  Description of Artificial Sequence: Synthetic oligonucleotide
caccaagaguucuguaugug

SEQ ID NO: 196 - RNA, 20 nt, Artificial Sequence
  Description of Artificial Sequence: Synthetic oligonucleotide
ccaccaagaguucuguaugu

SEQ ID NO: 197 - RNA, 20 nt, Artificial Sequence
  Description of Artificial Sequence: Synthetic oligonucleotide
accaccaagaguucuguaug

SEQ ID NO: 198 - RNA, 20 nt, Artificial Sequence
  Description of Artificial Sequence: Synthetic oligonucleotide
ggcucaaaaucuguuacugc

SEQ ID NO: 199 - RNA, 20 nt, Artificial Sequence
  Description of Artificial Sequence: Synthetic oligonucleotide
uggcucaaaaucuguuacug

SEQ ID NO: 200 - RNA, 20 nt, Artificial Sequence
  Description of Artificial Sequence: Synthetic oligonucleotide
uggguuggcucaaaaucugu

SEQ ID NO: 201 - RNA, 20 nt, Artificial Sequence
  Description of Artificial Sequence: Synthetic oligonucleotide
cuggguuggcucaaaaucug

SEQ ID NO: 202 - RNA, 20 nt, Artificial Sequence
  Description of Artificial Sequence: Synthetic oligonucleotide
ccuggguuggcucaaaaucu

SEQ ID NO: 203 - RNA, 20 nt, Artificial Sequence
  Description of Artificial Sequence: Synthetic oligonucleotide
ugccuggguuggcucaaaau

SEQ ID NO: 204 - RNA, 20 nt, Artificial Sequence
  Description of Artificial Sequence: Synthetic oligonucleotide
gugccuggguuggcucaaaa

SEQ ID NO: 205 - RNA, 20 nt, Artificial Sequence
  Description of Artificial Sequence: Synthetic oligonucleotide
cgugccuggguuggcucaaa

SEQ ID NO: 206 - RNA, 20 nt, Artificial Sequence
  Description of Artificial Sequence: Synthetic oligonucleotide
aagccaugcgugccuggguu

SEQ ID NO: 207 - RNA, 20 nt, Artificial Sequence
  Description of Artificial Sequence: Synthetic oligonucleotide
aaagccaugcgugccugggu

SEQ ID NO: 208 - RNA, 20 nt, Artificial Sequence
  Description of Artificial Sequence: Synthetic oligonucleotide
agggaaagccaugcgugccu

SEQ ID NO: 209 - RNA, 20 nt, Artificial Sequence
  Description of Artificial Sequence: Synthetic oligonucleotide
aagggaaagccaugcgugcc

SEQ ID NO: 210 - RNA, 20 nt, Artificial Sequence
  Description of Artificial Sequence: Synthetic oligonucleotide
gcaagggaaagccaugcgug

SEQ ID NO: 211 - RNA, 20 nt, Artificial Sequence
  Description of Artificial Sequence: Synthetic oligonucleotide
aagcaagggaaagccaugcg

SEQ ID NO: 212 - RNA, 20 nt, Artificial Sequence
  Description of Artificial Sequence: Synthetic oligonucleotide
caaagcaagggaaagccaug

SEQ ID NO: 213 - RNA, 20 nt, Artificial Sequence
  Description of Artificial Sequence: Synthetic oligonucleotide
caucaaagcaagggaaagcc

SEQ ID NO: 214 - RNA, 20 nt, Artificial Sequence
  Description of Artificial Sequence: Synthetic oligonucleotide
guucaucaaagcaagggaaa

SEQ ID NO: 215 - RNA, 20 nt, Artificial Sequence
  Description of Artificial Sequence: Synthetic oligonucleotide
cucucuucguaucuugauug

SEQ ID NO: 216 - RNA, 20 nt, Artificial Sequence
  Description of Artificial Sequence: Synthetic oligonucleotide
gcucucucuucguaucuuga

SEQ ID NO: 217 - RNA, 20 nt, Artificial Sequence
  Description of Artificial Sequence: Synthetic oligonucleotide
ccugcucucucuucguaucu

SEQ ID NO: 218 - RNA, 20 nt, Artificial Sequence
  Description of Artificial Sequence: Synthetic oligonucleotide
gccugcucucucuucguauc

SEQ ID NO: 219 - RNA, 20 nt, Artificial Sequence
  Description of Artificial Sequence: Synthetic oligonucleotide
gugcaauaugccugcucucu

SEQ ID NO: 220 - RNA, 20 nt, Artificial Sequence
  Description of Artificial Sequence: Synthetic oligonucleotide
agugcaauaugccugcucuc

SEQ ID NO: 221 - RNA, 20 nt, Artificial Sequence
  Description of Artificial Sequence: Synthetic oligonucleotide
uagugcaauaugccugcucu

SEQ ID NO: 222 - RNA, 20 nt, Artificial Sequence
  Description of Artificial Sequence: Synthetic oligonucleotide
auagugcaauaugccugcuc

SEQ ID NO: 223 - RNA, 20 nt, Artificial Sequence
  Description of Artificial Sequence: Synthetic oligonucleotide
uggauagugcaauaugccug

SEQ ID NO: 224 - RNA, 20 nt, Artificial Sequence
  Description of Artificial Sequence: Synthetic oligonucleotide
uuggauagugcaauaugccu

SEQ ID NO: 225 - RNA, 20 nt, Artificial Sequence
  Description of Artificial Sequence: Synthetic oligonucleotide
guuggauagugcaauaugcc

SEQ ID NO: 226 - RNA, 20 nt, Artificial Sequence
  Description of Artificial Sequence: Synthetic oligonucleotide
uguuggauagugcaauaugc

SEQ ID NO: 227 - RNA, 20 nt, Artificial Sequence
  Description of Artificial Sequence: Synthetic oligonucleotide
gcauguuggauagugcaaua

SEQ ID NO: 228 - RNA, 20 nt, Artificial Sequence
  Description of Artificial Sequence: Synthetic oligonucleotide
ggcauguuggauagugcaau

SEQ ID NO: 229 - RNA, 20 nt, Artificial Sequence
  Description of Artificial Sequence: Synthetic oligonucleotide
uggcauguuggauagugcaa

SEQ ID NO: 230 - RNA, 20 nt, Artificial Sequence
  Description of Artificial Sequence: Synthetic oligonucleotide
uuggcauguuggauagugca

SEQ ID NO: 231 - RNA, 20 nt, Artificial Sequence
  Description of Artificial Sequence: Synthetic oligonucleotide
uuuggcauguuggauagugc

SEQ ID NO: 232 - RNA, 20 nt, Artificial Sequence
  Description of Artificial Sequence: Synthetic oligonucleotide
cuuuggcauguuggauagug

SEQ ID NO: 233 - RNA, 20 nt, Artificial Sequence
  Description of Artificial Sequence: Synthetic oligonucleotide
gaccuccuucaaguucaauu

SEQ ID NO: 234 - RNA, 20 nt, Artificial Sequence
  Description of Artificial Sequence: Synthetic oligonucleotide
caaaagaccuccuucaaguu

SEQ ID NO: 235 - RNA, 20 nt, Artificial Sequence
  Description of Artificial Sequence: Synthetic oligonucleotide
uccaaaagaccuccuucaag

SEQ ID NO: 236 - RNA, 20 nt, Artificial Sequence
  Description of Artificial Sequence: Synthetic oligonucleotide
cuuccaaaagaccuccuuca

SEQ ID NO: 237 - RNA, 20 nt, Artificial Sequence
  Description of Artificial Sequence: Synthetic oligonucleotide
ucacaaacuauguaggcuac

SEQ ID NO: 238 - RNA, 20 nt, Artificial Sequence
  Description of Artificial Sequence: Synthetic oligonucleotide
agagaguggaaaucacaaac

SEQ ID NO: 239 - RNA, 20 nt, Artificial Sequence
  Description of Artificial Sequence: Synthetic oligonucleotide
ucagagaguggaaaucacaa

SEQ ID NO: 240 - RNA, 20 nt, Artificial Sequence
  Description of Artificial Sequence: Synthetic oligonucleotide
cccugaugaagugaagccac

SEQ ID NO: 241 - RNA, 20 nt, Artificial Sequence
  Description of Artificial Sequence: Synthetic oligonucleotide
auagauggacaccuugaccc

SEQ ID NO: 242 - RNA, 20 nt, Artificial Sequence
  Description of Artificial Sequence: Synthetic oligonucleotide
cauagauggacaccuugacc

SEQ ID NO: 243 - RNA, 20 nt, Artificial Sequence
  Description of Artificial Sequence: Synthetic oligonucleotide
gcauagauggacaccuugac

SEQ ID NO: 244 - RNA, 20 nt, Artificial Sequence
  Description of Artificial Sequence: Synthetic oligonucleotide
ugcauagauggacaccuuga

SEQ ID NO: 245 - RNA, 20 nt, Artificial Sequence
  Description of Artificial Sequence: Synthetic oligonucleotide
uuugauuccguuugucuggg

SEQ ID NO: 246 - RNA, 20 nt, Artificial Sequence
  Description of Artificial Sequence: Synthetic oligonucleotide
guuugauuccguuugucugg

SEQ ID NO: 247 - RNA, 20 nt, Artificial Sequence
  Description of Artificial Sequence: Synthetic oligonucleotide
uguuugauuccguuugucug

SEQ ID NO: 248 - RNA, 20 nt, Artificial Sequence
  Description of Artificial Sequence: Synthetic oligonucleotide
guguuugauuccguuugucu

SEQ ID NO: 249 - RNA, 20 nt, Artificial Sequence
  Description of Artificial Sequence: Synthetic oligonucleotide
gcauaauguguuugauuccg

SEQ ID NO: 250 - RNA, 20 nt, Artificial Sequence
  Description of Artificial Sequence: Synthetic oligonucleotide
ucagugaugccugcaaagca

SEQ ID NO: 251 - RNA, 20 nt, Artificial Sequence
  Description of Artificial Sequence: Synthetic oligonucleotide
guagcuucagugaugccugc

SEQ ID NO: 252 - RNA, 20 nt, Artificial Sequence
  Description of Artificial Sequence: Synthetic oligonucleotide
aguagcuucagugaugccug

SEQ ID NO: 253 - RNA, 20 nt, Artificial Sequence
  Description of Artificial Sequence: Synthetic oligonucleotide
ggagaguggauaguagauau

SEQ ID NO: 254 - RNA, 20 nt, Artificial Sequence
  Description of Artificial Sequence: Synthetic oligonucleotide
uggagaguggauaguagaua

SEQ ID NO: 255 - RNA, 20 nt, Artificial Sequence
  Description of Artificial Sequence: Synthetic oligonucleotide
uuggagaguggauaguagau

SEQ ID NO: 256 - RNA, 20 nt, Artificial Sequence
  Description of Artificial Sequence: Synthetic oligonucleotide
uuuggagaguggauaguaga

SEQ ID NO: 257 - RNA, 20 nt, Artificial Sequence
  Description of Artificial Sequence: Synthetic oligonucleotide
guuuggagaguggauaguag

SEQ ID NO: 258 - RNA, 20 nt, Artificial Sequence
  Description of Artificial Sequence: Synthetic oligonucleotide
caguuuggagaguggauagu

SEQ ID NO: 259 - RNA, 20 nt, Artificial Sequence
  Description of Artificial Sequence: Synthetic oligonucleotide
gcaaagucaggaauagcaau

SEQ ID NO: 260 - RNA, 20 nt, Artificial Sequence
  Description of Artificial Sequence: Synthetic oligonucleotide
ugcaaagucaggaauagcaa

SEQ ID NO: 261 - RNA, 20 nt, Artificial Sequence
  Description of Artificial Sequence: Synthetic oligonucleotide
gugcaaagucaggaauagca

SEQ ID NO: 262 - RNA, 20 nt, Artificial Sequence
  Description of Artificial Sequence: Synthetic oligonucleotide
ggugcaaagucaggaauagc

SEQ ID NO: 263 - RNA, 20 nt, Artificial Sequence
  Description of Artificial Sequence: Synthetic oligonucleotide
aggugcaaagucaggaauag

SEQ ID NO: 264 - RNA, 20 nt, Artificial Sequence
  Description of Artificial Sequence: Synthetic oligonucleotide
caggugcaaagucaggaaua

SEQ ID NO: 265 - RNA, 20 nt, Artificial Sequence
  Description of Artificial Sequence: Synthetic oligonucleotide
ccaggugcaaagucaggaau

SEQ ID NO: 266 - RNA, 20 nt, Artificial Sequence
  Description of Artificial Sequence: Synthetic oligonucleotide
uccaggugcaaagucaggaa

SEQ ID NO: 267 - RNA, 20 nt, Artificial Sequence
  Description of Artificial Sequence: Synthetic oligonucleotide
cuccaggugcaaagucagga

SEQ ID NO: 268 - RNA, 20 nt, Artificial Sequence
  Description of Artificial Sequence: Synthetic oligonucleotide
gcuccaggugcaaagucagg

SEQ ID NO: 269 - RNA, 20 nt, Artificial Sequence
  Description of Artificial Sequence: Synthetic oligonucleotide
ggcuccaggugcaaagucag

SEQ ID NO: 270 - RNA, 20 nt, Artificial Sequence
  Description of Artificial Sequence: Synthetic oligonucleotide
cucccuauauguaaugaggc

SEQ ID NO: 271 - RNA, 20 nt, Artificial Sequence
  Description of Artificial Sequence: Synthetic oligonucleotide
ggaagcagaagaggucuugg

SEQ ID NO: 272 - RNA, 20 nt, Artificial Sequence
  Description of Artificial Sequence: Synthetic oligonucleotide
cggaagcagaagaggucuug

SEQ ID NO: 273 - RNA, 20 nt, Artificial Sequence
  Description of Artificial Sequence: Synthetic oligonucleotide
ucggaagcagaagaggucuu

SEQ ID NO: 274 - RNA, 20 nt, Artificial Sequence
  Description of Artificial Sequence: Synthetic oligonucleotide
aucggaagcagaagaggucu

SEQ ID NO: 275 - RNA, 20 nt, Artificial Sequence
  Description of Artificial Sequence: Synthetic oligonucleotide
uaucggaagcagaagagguc

SEQ ID NO: 276 - RNA, 20 nt, Artificial Sequence
  Description of Artificial Sequence: Synthetic oligonucleotide
uuaucggaagcagaagaggu

SEQ ID NO: 277 - RNA, 20 nt, Artificial Sequence
  Description of Artificial Sequence: Synthetic oligonucleotide
uuuaucggaagcagaagagg

SEQ ID NO: 278 - RNA, 20 nt, Artificial Sequence
  Description of Artificial Sequence: Synthetic oligonucleotide
guuuaucggaagcagaagag

SEQ ID NO: 279 - RNA, 20 nt, Artificial Sequence
  Description of Artificial Sequence: Synthetic oligonucleotide
aguuuaucggaagcagaaga

SEQ ID NO: 280 - RNA, 20 nt, Artificial Sequence
  Description of Artificial Sequence: Synthetic oligonucleotide
caguuuaucggaagcagaag

SEQ ID NO: 281 - RNA, 20 nt, Artificial Sequence
  Description of Artificial Sequence: Synthetic oligonucleotide
ccacaguuuaucggaagcag

SEQ ID NO: 282 - RNA, 20 nt, Artificial Sequence
  Description of Artificial Sequence: Synthetic oligonucleotide
cccacaguuuaucggaagca

SEQ ID NO: 283 - RNA, 20 nt, Artificial Sequence
  Description of Artificial Sequence: Synthetic oligonucleotide
acccacaguuuaucggaagc

SEQ ID NO: 284 - RNA, 20 nt, Artificial Sequence
  Description of Artificial Sequence: Synthetic oligonucleotide
gacccacaguuuaucggaag

SEQ ID NO: 285 - RNA, 20 nt, Artificial Sequence
  Description of Artificial Sequence: Synthetic oligonucleotide
ugacccacaguuuaucggaa

SEQ ID NO: 286 - RNA, 20 nt, Artificial Sequence
  Description of Artificial Sequence: Synthetic oligonucleotide
gugacccacaguuuaucgga

SEQ ID NO: 287 - RNA, 20 nt, Artificial Sequence
  Description of Artificial Sequence: Synthetic oligonucleotide
ggugacccacaguuuaucgg

SEQ ID NO: 288 - RNA, 20 nt, Artificial Sequence
  Description of Artificial Sequence: Synthetic oligonucleotide
uggugacccacaguuuaucg

SEQ ID NO: 289 - RNA, 20 nt, Artificial Sequence
  Description of Artificial Sequence: Synthetic oligonucleotide
cuggugacccacaguuuauc

SEQ ID NO: 290 - RNA, 20 nt, Artificial Sequence
  Description of Artificial Sequence: Synthetic oligonucleotide
cucuggugacccacaguuua

SEQ ID NO: 291 - RNA, 20 nt, Artificial Sequence
  Description of Artificial Sequence: Synthetic oligonucleotide
acucuggugacccacaguuu

SEQ ID NO: 292 - RNA, 20 nt, Artificial Sequence
  Description of Artificial Sequence: Synthetic oligonucleotide
gacucuggugacccacaguu

SEQ ID NO: 293 - RNA, 20 nt, Artificial Sequence
  Description of Artificial Sequence: Synthetic oligonucleotide
augacucuggugacccacag

SEQ ID NO: 294 - RNA, 20 nt, Artificial Sequence
  Description of Artificial Sequence: Synthetic oligonucleotide
uaugacucuggugacccaca

SEQ ID NO: 295 - RNA, 20 nt, Artificial Sequence
  Description of Artificial Sequence: Synthetic oligonucleotide
cuaugacucuggugacccac

SEQ ID NO: 296 - RNA, 20 nt, Artificial Sequence
  Description of Artificial Sequence: Synthetic oligonucleotide
ggcuaugacucuggugaccc

SEQ ID NO: 297 - RNA, 20 nt, Artificial Sequence
  Description of Artificial Sequence: Synthetic oligonucleotide
gggcuaugacucuggugacc

SEQ ID NO: 298 - RNA, 20 nt, Artificial Sequence
  Description of Artificial Sequence: Synthetic oligonucleotide
ugggcuaugacucuggugac

SEQ ID NO: 299 - RNA, 20 nt, Artificial Sequence
  Description of Artificial Sequence: Synthetic oligonucleotide
augggcuaugacucugguga

SEQ ID NO: 300 - RNA, 20 nt, Artificial Sequence
  Description of Artificial Sequence: Synthetic oligonucleotide
gcgccaguucaugggcuaug

SEQ ID NO: 301 - RNA, 20 nt, Artificial Sequence
  Description of Artificial Sequence: Synthetic oligonucleotide
gugcgccaguucaugggcua

SEQ ID NO: 302 - RNA, 20 nt, Artificial Sequence
  Description of Artificial Sequence: Synthetic oligonucleotide
uugccaaaccacuggugcgc

SEQ ID NO: 303 - RNA, 20 nt, Artificial Sequence
  Description of Artificial Sequence: Synthetic oligonucleotide
guugccaaaccacuggugcg

SEQ ID NO: 304 - RNA, 20 nt, Artificial Sequence
  Description of Artificial Sequence: Synthetic oligonucleotide
uugugaccagguugccaaac

SEQ ID NO: 305 - RNA, 20 nt, Artificial Sequence
  Description of Artificial Sequence: Synthetic oligonucleotide
auugugaccagguugccaaa

SEQ ID NO: 306 - RNA, 20 nt, Artificial Sequence
  Description of Artificial Sequence: Synthetic oligonucleotide
cauugugaccagguugccaa

SEQ ID NO: 307 - RNA, 20 nt, Artificial Sequence
  Description of Artificial Sequence: Synthetic oligonucleotide
uccauugugaccagguugcc

SEQ ID NO: 308 - RNA, 20 nt, Artificial Sequence
  Description of Artificial Sequence: Synthetic oligonucleotide
uuccauugugaccagguugc

SEQ ID NO: 309 - RNA, 20 nt, Artificial Sequence
  Description of Artificial Sequence: Synthetic oligonucleotide
auuccauugugaccagguug

SEQ ID NO: 310 - RNA, 20 nt, Artificial Sequence
  Description of Artificial Sequence: Synthetic oligonucleotide
ccauuccauugugaccaggu

SEQ ID NO: 311 - RNA, 20 nt, Artificial Sequence
  Description of Artificial Sequence: Synthetic oligonucleotide
accauuccauugugaccagg

SEQ ID NO: 312 - RNA, 20 nt, Artificial Sequence
  Description of Artificial Sequence: Synthetic oligonucleotide
caccauuccauugugaccag

SEQ ID NO: 313 - RNA, 20 nt, Artificial Sequence
  Description of Artificial Sequence: Synthetic oligonucleotide
ccaccauuccauugugacca

SEQ ID NO: 314 - RNA, 20 nt, Artificial Sequence
  Description of Artificial Sequence: Synthetic oligonucleotide
uccaccauuccauugugacc

SEQ ID NO: 315 - RNA, 20 nt, Artificial Sequence
  Description of Artificial Sequence: Synthetic oligonucleotide
uuccaccauuccauugugac

SEQ ID NO: 316 - RNA, 20 nt, Artificial Sequence
  Description of Artificial Sequence: Synthetic oligonucleotide
cagcgauaaguuccauguau

SEQ ID NO: 317 - RNA, 20 nt, Artificial Sequence
  Description of Artificial Sequence: Synthetic oligonucleotide
acagcgauaaguuccaugua

SEQ ID NO: 318 - RNA, 20 nt, Artificial Sequence
  Description of Artificial Sequence: Synthetic oligonucleotide
aacagcgauaaguuccaugu

SEQ ID NO: 319 - RNA, 20 nt, Artificial Sequence
  Description of Artificial Sequence: Synthetic oligonucleotide
uaacagcgauaaguuccaug

SEQ ID NO: 320 - RNA, 20 nt, Artificial Sequence
  Description of Artificial Sequence: Synthetic oligonucleotide
cauuaacagcgauaaguucc

SEQ ID NO: 321 - RNA, 20 nt, Artificial Sequence
  Description of Artificial Sequence: Synthetic oligonucleotide
gcauuaacagcgauaaguuc

SEQ ID NO: 322 - RNA, 20 nt, Artificial Sequence
  Description of Artificial Sequence: Synthetic oligonucleotide
guagcauuaacagcgauaag

SEQ ID NO: 323 - RNA, 20 nt, Artificial Sequence
  Description of Artificial Sequence: Synthetic oligonucleotide
gauauguagcauuaacagcg

SEQ ID NO: 324 - RNA, 20 nt, Artificial Sequence
  Description of Artificial Sequence: Synthetic oligonucleotide
gcucuggauauguagcauua

SEQ ID NO: 325 - RNA, 20 nt, Artificial Sequence
  Description of Artificial Sequence: Synthetic oligonucleotide
guuuccgcugguuuggagau

SEQ ID NO: 326 - RNA, 20 nt, Artificial Sequence
  Description of Artificial Sequence: Synthetic oligonucleotide
gguuuccgcugguuuggaga

SEQ ID NO: 327 - RNA, 20 nt, Artificial Sequence
  Description of Artificial Sequence: Synthetic oligonucleotide
ggguuuccgcugguuuggag

SEQ ID NO: 328 - RNA, 20 nt, Artificial Sequence
  Description of Artificial Sequence: Synthetic oligonucleotide
cauuuccuguauuugagucg

SEQ ID NO: 329 - RNA, 20 nt, Artificial Sequence
  Description of Artificial Sequence: Synthetic oligonucleotide
cccuuguuauaggaaacuuc

SEQ ID NO: 330 - RNA, 20 nt, Artificial Sequence
  Description of Artificial Sequence: Synthetic oligonucleotide
cucccuuguuauaggaaacu

SEQ ID NO: 331 - RNA, 20 nt, Artificial Sequence
  Description of Artificial Sequence: Synthetic oligonucleotide
gcucccuuguuauaggaaac

SEQ ID NO: 332 - RNA, 20 nt, Artificial Sequence
  Description of Artificial Sequence: Synthetic oligonucleotide
agcucccuuguuauaggaaa

SEQ ID NO: 333 - RNA, 20 nt, Artificial Sequence
  Description of Artificial Sequence: Synthetic oligonucleotide
aagcucccuuguuauaggaa

SEQ ID NO: 334 - RNA, 20 nt, Artificial Sequence
  Description of Artificial Sequence: Synthetic oligonucleotide
cccagaaaauccuugagcau

SEQ ID NO: 335 - RNA, 20 nt, Artificial Sequence
  Description of Artificial Sequence: Synthetic oligonucleotide
cucacccagaaaauccuuga

SEQ ID NO: 336 - RNA, 20 nt, Artificial Sequence
  Description of Artificial Sequence: Synthetic oligonucleotide
cuccucacccagaaaauccu

SEQ ID NO: 337 - RNA, 20 nt, Artificial Sequence
  Description of Artificial Sequence: Synthetic oligonucleotide
ucuccucacccagaaaaucc

SEQ ID NO: 338 - RNA, 20 nt, Artificial Sequence
  Description of Artificial Sequence: Synthetic oligonucleotide
ccacaagucaucauucuuag

SEQ ID NO: 339 - RNA, 20 nt, Artificial Sequence
  Description of Artificial Sequence: Synthetic oligonucleotide
cugcuccacaagucaucauu

SEQ ID NO: 340 - RNA, 20 nt, Artificial Sequence
  Description of Artificial Sequence: Synthetic oligonucleotide
acugcuccacaagucaucau

SEQ ID NO: 341 - RNA, 20 nt, Artificial Sequence
  Description of Artificial Sequence: Synthetic oligonucleotide
ugacagacugcuccacaagu

SEQ ID NO: 342 - RNA, 20 nt, Artificial Sequence
  Description of Artificial Sequence: Synthetic oligonucleotide
uugacagacugcuccacaag

SEQ ID NO: 343 - RNA, 20 nt, Artificial Sequence
  Description of Artificial Sequence: Synthetic oligonucleotide
auuugacagacugcuccaca

SEQ ID NO: 344 - RNA, 20 nt, Artificial Sequence
  Description of Artificial Sequence: Synthetic oligonucleotide
uauuugacagacugcuccac

SEQ ID NO: 345 - RNA, 20 nt, Artificial Sequence
  Description of Artificial Sequence: Synthetic oligonucleotide
cuauuugacagacugcucca

SEQ ID NO: 346 - RNA, 20 nt, Artificial Sequence
  Description of Artificial Sequence: Synthetic oligonucleotide
acuauuugacagacugcucc

SEQ ID NO: 347 - RNA, 20 nt, Artificial Sequence
  Description of Artificial Sequence: Synthetic oligonucleotide
aacuauuugacagacugcuc

SEQ ID NO: 348 - RNA, 20 nt, Artificial Sequence
  Description of Artificial Sequence: Synthetic oligonucleotide
caacuauuugacagacugcu

SEQ ID NO: 349 - RNA, 20 nt, Artificial Sequence
  Description of Artificial Sequence: Synthetic oligonucleotide
acaacuauuugacagacugc

SEQ ID NO: 350 - RNA, 20 nt, Artificial Sequence
  Description of Artificial Sequence: Synthetic oligonucleotide
ccaccagauguaaaaucacu

SEQ ID NO: 351 - RNA, 20 nt, Artificial Sequence
  Description of Artificial Sequence: Synthetic oligonucleotide
uccaccagauguaaaaucac

SEQ ID NO: 352 - RNA, 20 nt, Artificial Sequence
  Description of Artificial Sequence: Synthetic oligonucleotide
gacaaacuccaccagaugua

SEQ ID NO: 353 - RNA, 20 nt, Artificial Sequence
  Description of Artificial Sequence: Synthetic oligonucleotide
cgaaugacaaacuccaccag

SEQ ID NO: 354 - RNA, 20 nt, Artificial Sequence
  Description of Artificial Sequence: Synthetic oligonucleotide
ccgaaugacaaacuccacca

SEQ ID NO: 355 - RNA, 20 nt, Artificial Sequence
  Description of Artificial Sequence: Synthetic oligonucleotide
gauccgaaugacaaacucca

SEQ ID NO: 356 - RNA, 20 nt, Artificial Sequence
  Description of Artificial Sequence: Synthetic oligonucleotide
auguuacuugucaucuuggg

SEQ ID NO: 357 - RNA, 20 nt, Artificial Sequence
  Description of Artificial Sequence: Synthetic oligonucleotide
gcauguuacuugucaucuug

SEQ ID NO: 358 - RNA, 20 nt, Artificial Sequence
  Description of Artificial Sequence: Synthetic oligonucleotide
gagcauguuacuugucaucu

SEQ ID NO: 359 - RNA, 20 nt, Artificial Sequence
  Description of Artificial Sequence: Synthetic oligonucleotide
cgagcauguuacuugucauc

SEQ ID NO: 360 - RNA, 20 nt, Artificial Sequence
  Description of Artificial Sequence: Synthetic oligonucleotide
gcgagcauguuacuugucau

SEQ ID NO: 361 - RNA, 20 nt, Artificial Sequence
  Description of Artificial Sequence: Synthetic oligonucleotide
ggcgagcauguuacuuguca

SEQ ID NO: 362 - RNA, 20 nt, Artificial Sequence
  Description of Artificial Sequence: Synthetic oligonucleotide
aggcgagcauguuacuuguc

SEQ ID NO: 363 - RNA, 20 nt, Artificial Sequence
  Description of Artificial Sequence: Synthetic oligonucleotide
aaggcgagcauguuacuugu

SEQ ID NO: 364 - RNA, 20 nt, Artificial Sequence
  Description of Artificial Sequence: Synthetic oligonucleotide
aaaggcgagcauguuacuug

SEQ ID NO: 365 - RNA, 20 nt, Artificial Sequence
  Description of Artificial Sequence: Synthetic oligonucleotide
gaaaggcgagcauguuacuu

SEQ ID NO: 366 - RNA, 20 nt, Artificial Sequence
  Description of Artificial Sequence: Synthetic oligonucleotide
agaaaggcgagcauguuacu

SEQ ID NO: 367 - RNA, 20 nt, Artificial Sequence
  Description of Artificial Sequence: Synthetic oligonucleotide
cagaaaggcgagcauguuac

SEQ ID NO: 368 - RNA, 20 nt, Artificial Sequence
  Description of Artificial Sequence: Synthetic oligonucleotide
ccagaaaggcgagcauguua

SEQ ID NO: 369 - RNA, 20 nt, Artificial Sequence
  Description of Artificial Sequence: Synthetic oligonucleotide
cccagaaaggcgagcauguu

SEQ ID NO: 370 - RNA, 20 nt, Artificial Sequence
  Description of Artificial Sequence: Synthetic oligonucleotide
ucuuugaccucugcauuuuc

SEQ ID NO: 371 - RNA, 20 nt, Artificial Sequence
  Description of Artificial Sequence: Synthetic oligonucleotide
aucaucucuuugaccucugc

SEQ ID NO: 372 - RNA, 20 nt, Artificial Sequence
  Description of Artificial Sequence: Synthetic oligonucleotide
ccauguagucaucaucucuu

SEQ ID NO: 373 - RNA, 20 nt, Artificial Sequence
  Description of Artificial Sequence: Synthetic oligonucleotide
agaguccauguagucaucau

SEQ ID NO: 374 - RNA, 20 nt, Artificial Sequence
  Description of Artificial Sequence: Synthetic oligonucleotide
gagaguccauguagucauca

SEQ ID NO: 375 - RNA, 20 nt, Artificial Sequence
  Description of Artificial Sequence: Synthetic oligonucleotide
ggagaguccauguagucauc

SEQ ID NO: 376 - RNA, 20 nt, Artificial Sequence
  Description of Artificial Sequence: Synthetic oligonucleotide
gauuccuuucuggagagucc

SEQ ID NO: 377 - RNA, 20 nt, Artificial Sequence
  Description of Artificial Sequence: Synthetic oligonucleotide
uuguuuaaccaccagcaggg

SEQ ID NO: 378 - RNA, 20 nt, Artificial Sequence
  Description of Artificial Sequence: Synthetic oligonucleotide
cuuguuuaaccaccagcagg

SEQ ID NO: 379 - RNA, 20 nt, Artificial Sequence
  Description of Artificial Sequence: Synthetic oligonucleotide
ucuuguuuaaccaccagcag

SEQ ID NO: 380 - RNA, 20 nt, Artificial Sequence
  Description of Artificial Sequence: Synthetic oligonucleotide
cgucuuguuuaaccaccagc

SEQ ID NO: 381 - RNA, 20 nt, Artificial Sequence
  Description of Artificial Sequence: Synthetic oligonucleotide
ccgucuuguuuaaccaccag

SEQ ID NO: 382 - RNA, 20 nt, Artificial Sequence
  Description of Artificial Sequence: Synthetic oligonucleotide
cccgucuuguuuaaccacca

SEQ ID NO: 383 - RNA, 20 nt, Artificial Sequence
  Description of Artificial Sequence: Synthetic oligonucleotide
acccgucuuguuuaaccacc

SEQ ID NO: 384 - RNA, 20 nt, Artificial Sequence
  Description of Artificial Sequence: Synthetic oligonucleotide
cacccgucuuguuuaaccac

SEQ ID NO: 385 - RNA, 20 nt, Artificial Sequence
  Description of Artificial Sequence: Synthetic oligonucleotide
acacccgucuuguuuaacca

SEQ ID NO: 386 - RNA, 20 nt, Artificial Sequence
  Description of Artificial Sequence: Synthetic oligonucleotide
ggagugaacacccgucuugu

SEQ ID NO: 387 - RNA, 20 nt, Artificial Sequence
  Description of Artificial Sequence: Synthetic oligonucleotide
cggagugaacacccgucuug

SEQ ID NO: 388 - RNA, 20 nt, Artificial Sequence
  Description of Artificial Sequence: Synthetic oligonucleotide
ucggagugaacacccgucuu

SEQ ID NO: 389 - RNA, 20 nt, Artificial Sequence
  Description of Artificial Sequence: Synthetic oligonucleotide
gucggagugaacacccgucu

SEQ ID NO: 390 - RNA, 20 nt, Artificial Sequence
  Description of Artificial Sequence: Synthetic oligonucleotide
agucggagugaacacccguc

SEQ ID NO: 391 - RNA, 20 nt, Artificial Sequence
  Description of Artificial Sequence: Synthetic oligonucleotide
cagucggagugaacacccgu

SEQ ID NO: 392 - RNA, 20 nt, Artificial Sequence
  Description of Artificial Sequence: Synthetic oligonucleotide
ugcagucggagugaacaccc

SEQ ID NO: 393 - RNA, 20 nt, Artificial Sequence
  Description of Artificial Sequence: Synthetic oligonucleotide
uugcagucggagugaacacc

SEQ ID NO: 394 - RNA, 20 nt, Artificial Sequence
  Description of Artificial Sequence: Synthetic oligonucleotide
guugcagucggagugaacac

SEQ ID NO: 395 - RNA, 20 nt, Artificial Sequence
  Description of Artificial Sequence: Synthetic oligonucleotide
ccuccauucagggucuuccu

SEQ ID NO: 396 - RNA, 20 nt, Artificial Sequence
  Description of Artificial Sequence: Synthetic oligonucleotide
augggauaugccacagguac

SEQ ID NO: 397 - RNA, 20 nt, Artificial Sequence
  Description of Artificial Sequence: Synthetic oligonucleotide
aaugggauaugccacaggua

SEQ ID NO: 398 - RNA, 20 nt, Artificial Sequence
  Description of Artificial Sequence: Synthetic oligonucleotide
caaugggauaugccacaggu

SEQ ID NO: 399 - RNA, 20 nt, Artificial Sequence
  Description of Artificial Sequence: Synthetic oligonucleotide
ucaaugggauaugccacagg

SEQ ID NO: 400 - RNA, 20 nt, Artificial Sequence
  Description of Artificial Sequence: Synthetic oligonucleotide
guaggucaaugggauaugcc

SEQ ID NO: 401 - RNA, 20 nt, Artificial Sequence
  Description of Artificial Sequence: Synthetic oligonucleotide
aguaggucaaugggauaugc

SEQ ID NO: 402 - RNA, 20 nt, Artificial Sequence
  Description of Artificial Sequence: Synthetic oligonucleotide
gaguaggucaaugggauaug

SEQ ID NO: 403 - RNA, 20 nt, Artificial Sequence
  Description of Artificial Sequence: Synthetic oligonucleotide
ggaguaggucaaugggauau

SEQ ID NO: 404 - RNA, 20 nt, Artificial Sequence
  Description of Artificial Sequence: Synthetic oligonucleotide
uggaguaggucaaugggaua

SEQ ID NO: 405 - RNA, 20 nt, Artificial Sequence
  Description of Artificial Sequence: Synthetic oligonucleotide
cguggaguaggucaauggga

SEQ ID NO: 406 - RNA, 20 nt, Artificial Sequence
  Description of Artificial Sequence: Synthetic oligonucleotide
ucguggaguaggucaauggg

SEQ ID NO: 407 - RNA, 20 nt, Artificial Sequence
  Description of Artificial Sequence: Synthetic oligonucleotide
cucguggaguaggucaaugg

SEQ ID NO: 408 - RNA, 20 nt, Artificial Sequence
  Description of Artificial Sequence: Synthetic oligonucleotide
cauuagaagaacucguggag

SEQ ID NO: 409 - RNA, 20 nt, Artificial Sequence
  Description of Artificial Sequence: Synthetic oligonucleotide
acauuagaagaacucgugga

SEQ ID NO: 410 - RNA, 20 nt, Artificial Sequence
  Description of Artificial Sequence: Synthetic oligonucleotide
ucacauuagaagaacucgug

SEQ ID NO: 411 - RNA, 20 nt, Artificial Sequence
  Description of Artificial Sequence: Synthetic oligonucleotide
gaucacauuagaagaacucg

SEQ ID NO: 412 - RNA, 20 nt, Artificial Sequence
  Description of Artificial Sequence: Synthetic oligonucleotide
ggaucacauuagaagaacuc

SEQ ID NO: 413 - RNA, 20 nt, Artificial Sequence
  Description of Artificial Sequence: Synthetic oligonucleotide
guggaucacauuagaagaac

SEQ ID NO: 414 - RNA, 20 nt, Artificial Sequence
  Description of Artificial Sequence: Synthetic oligonucleotide
agaaugugucuguggaucac

SEQ ID NO: 415 - RNA, 20 nt, Artificial Sequence
  Description of Artificial Sequence: Synthetic oligonucleotide
uagaaugugucuguggauca

SEQ ID NO: 416 - RNA, 20 nt, Artificial Sequence
  Description of Artificial Sequence: Synthetic oligonucleotide
uuucagguagauccagagua

SEQ ID NO: 417 - RNA, 20 nt, Artificial Sequence
  Description of Artificial Sequence: Synthetic oligonucleotide
uuuucagguagauccagagu

SEQ ID NO: 418 - RNA, 20 nt, Artificial Sequence
  Description of Artificial Sequence: Synthetic oligonucleotide
ucuuuucagguagauccaga

SEQ ID NO: 419 - RNA, 20 nt, Artificial Sequence
  Description of Artificial Sequence: Synthetic oligonucleotide
gucuuuucagguagauccag

SEQ ID NO: 420 - RNA, 20 nt, Artificial Sequence
  Description of Artificial Sequence: Synthetic oligonucleotide
ggucuuuucagguagaucca

SEQ ID NO: 421 - RNA, 20 nt, Artificial Sequence
  Description of Artificial Sequence: Synthetic oligonucleotide
cuggucuuuucagguagauc

SEQ ID NO: 422 - RNA, 20 nt, Artificial Sequence
  Description of Artificial Sequence: Synthetic oligonucleotide
ccaacuggucuuuucaggua

SEQ ID NO: 423 - RNA, 20 nt, Artificial Sequence
  Description of Artificial Sequence: Synthetic oligonucleotide
cccaacuggucuuuucaggu

SEQ ID NO: 424 - RNA, 20 nt, Artificial Sequence
  Description of Artificial Sequence: Synthetic oligonucleotide
acccaacuggucuuuucagg

SEQ ID NO: 425 - RNA, 20 nt, Artificial Sequence
  Description of Artificial Sequence: Synthetic oligonucleotide
cacccaacuggucuuuucag

SEQ ID NO: 426 - RNA, 20 nt, Artificial Sequence
  Description of Artificial Sequence: Synthetic oligonucleotide
uucacccaacuggucuuuuc

SEQ ID NO: 427 - RNA, 20 nt, Artificial Sequence
  Description of Artificial Sequence: Synthetic oligonucleotide
uuucacccaacuggucuuuu

SEQ ID NO: 428 - RNA, 20 nt, Artificial Sequence
  Description of Artificial Sequence: Synthetic oligonucleotide
auuucacccaacuggucuuu

SEQ ID NO: 429 - RNA, 20 nt, Artificial Sequence
  Description of Artificial Sequence: Synthetic oligonucleotide
aauuucacccaacuggucuu

SEQ ID NO: 430 - RNA, 20 nt, Artificial Sequence
  Description of Artificial Sequence: Synthetic oligonucleotide
guaaccauuugaguccacau

SEQ ID NO: 431 - RNA, 20 nt, Artificial Sequence
  Description of Artificial Sequence: Synthetic oligonucleotide
aguaaccauuugaguccaca

SEQ ID NO: 432 - RNA, 20 nt, Artificial Sequence
  Description of Artificial Sequence: Synthetic oligonucleotide
guaguaaccauuugagucca

SEQ ID NO: 433 - RNA, 20 nt, Artificial Sequence
  Description of Artificial Sequence: Synthetic oligonucleotide
uguaguaaccauuugagucc

SEQ ID NO: 434 - RNA, 20 nt, Artificial Sequence
  Description of Artificial Sequence: Synthetic oligonucleotide
cgauguaguaaccauuugag

SEQ ID NO: 435 - RNA, 20 nt, Artificial Sequence
  Description of Artificial Sequence: Synthetic oligonucleotide
agugaacgauguaguaacca

SEQ ID NO: 436 - RNA, 20 nt, Artificial Sequence
  Description of Artificial Sequence: Synthetic oligonucleotide
uagugaacgauguaguaacc

SEQ ID NO: 437 - RNA, 20 nt, Artificial Sequence
  Description of Artificial Sequence: Synthetic oligonucleotide
cucauagugaacgauguagu

SEQ ID NO: 438 - RNA, 20 nt, Artificial Sequence
  Description of Artificial Sequence: Synthetic oligonucleotide
ccucauagugaacgauguag

SEQ ID NO: 439 - RNA, 20 nt, Artificial Sequence
  Description of Artificial Sequence: Synthetic oligonucleotide
cccucauagugaacgaugua

SEQ ID NO: 440 - RNA, 20 nt, Artificial Sequence
  Description of Artificial Sequence: Synthetic oligonucleotide
acccucauagugaacgaugu

SEQ ID NO: 441 - RNA, 20 nt, Artificial Sequence
  Description of Artificial Sequence: Synthetic oligonucleotide
gacccucauagugaacgaug

SEQ ID NO: 442 - RNA, 20 nt, Artificial Sequence
  Description of Artificial Sequence: Synthetic oligonucleotide
ugacccucauagugaacgau

SEQ ID NO: 443 - RNA, 20 nt, Artificial Sequence
  Description of Artificial Sequence: Synthetic oligonucleotide
gaguuggucccauccaugac

SEQ ID NO: 444 - RNA, 20 nt, Artificial Sequence
  Description of Artificial Sequence: Synthetic oligonucleotide
augaguuggucccauccaug

SEQ ID NO: 445 - RNA, 20 nt, Artificial Sequence
  Description of Artificial Sequence: Synthetic oligonucleotide
aaugaguuggucccauccau

SEQ ID NO: 446 - RNA, 20 nt, Artificial Sequence
  Description of Artificial Sequence: Synthetic oligonucleotide
uaaugaguuggucccaucca

SEQ ID NO: 447 - RNA, 20 nt, Artificial Sequence
  Description of Artificial Sequence: Synthetic oligonucleotide
guaaugaguuggucccaucc

SEQ ID NO: 448 - RNA, 20 nt, Artificial Sequence
  Description of Artificial Sequence: Synthetic oligonucleotide
uguaaugaguuggucccauc

SEQ ID NO: 449 - RNA, 20 nt, Artificial Sequence
  Description of Artificial Sequence: Synthetic oligonucleotide
guguaaugaguuggucccau

SEQ ID NO: 450 - RNA, 20 nt, Artificial Sequence
  Description of Artificial Sequence: Synthetic oligonucleotide
uguguaaugaguugguccca

SEQ ID NO: 451 - RNA, 20 nt, Artificial Sequence
  Description of Artificial Sequence: Synthetic oligonucleotide
cuguguaaugaguugguccc

SEQ ID NO: 452 - RNA, 20 nt, Artificial Sequence
  Description of Artificial Sequence: Synthetic oligonucleotide
gcuguguaaugaguuggucc

SEQ ID NO: 453 - RNA, 20 nt, Artificial Sequence
  Description of Artificial Sequence: Synthetic oligonucleotide
agcuguguaaugaguugguc

SEQ ID NO: 454 - RNA, 20 nt, Artificial Sequence
  Description of Artificial Sequence: Synthetic oligonucleotide
gugugugguucugauucagc

SEQ ID NO: 455 - RNA, 20 nt, Artificial Sequence
  Description of Artificial Sequence: Synthetic oligonucleotide
aagugugugguucugauuca

SEQ ID NO: 456 - RNA, 20 nt, Artificial Sequence
  Description of Artificial Sequence: Synthetic oligonucleotide
cuuaggucugagaagugugu

SEQ ID NO: 457 - RNA, 20 nt, Artificial Sequence
  Description of Artificial Sequence: Synthetic oligonucleotide
ccuuaggucugagaagugug

SEQ ID NO: 458 - RNA, 20 nt, Artificial Sequence
  Description of Artificial Sequence: Synthetic oligonucleotide
uccuuaggucugagaagugu

SEQ ID NO: 459 - RNA, 20 nt, Artificial Sequence
  Description of Artificial Sequence: Synthetic oligonucleotide
guccuuaggucugagaagug

SEQ ID NO: 460 - RNA, 20 nt, Artificial Sequence
  Description of Artificial Sequence: Synthetic oligonucleotide
uguccuuaggucugagaagu

SEQ ID NO: 461 - RNA, 20 nt, Artificial Sequence
  Description of Artificial Sequence: Synthetic oligonucleotide
acucuguccuuaggucugag

SEQ ID NO: 462 - RNA, 20 nt, Artificial Sequence
  Description of Artificial Sequence: Synthetic oligonucleotide
uacucuguccuuaggucuga

SEQ ID NO: 463 - RNA, 20 nt, Artificial Sequence
  Description of Artificial Sequence: Synthetic oligonucleotide
cuacucuguccuuaggucug

SEQ ID NO: 464 - RNA, 20 nt, Artificial Sequence
  Description of Artificial Sequence: Synthetic oligonucleotide
ucagucucccugcaccaacu

SEQ ID NO: 465 - RNA, 20 nt, Artificial Sequence
  Description of Artificial Sequence: Synthetic oligonucleotide
gucagucucccugcaccaac

SEQ ID NO: 466 - RNA, 20 nt, Artificial Sequence
  Description of Artificial Sequence: Synthetic oligonucleotide
ggucagucucccugcaccaa

SEQ ID NO: 467 - RNA, 20 nt, Artificial Sequence
  Description of Artificial Sequence: Synthetic oligonucleotide
uugucuagggucagucuccc

SEQ ID NO: 468 - RNA, 20 nt, Artificial Sequence
  Description of Artificial Sequence: Synthetic oligonucleotide
uuugucuagggucagucucc

SEQ ID NO: 469 - RNA, 20 nt, Artificial Sequence
  Description of Artificial Sequence: Synthetic oligonucleotide
cuuugucuagggucagucuc

SEQ ID NO: 470 - RNA, 20 nt, Artificial Sequence
  Description of Artificial Sequence: Synthetic oligonucleotide
gcuuugucuagggucagucu

SEQ ID NO: 471 - RNA, 20 nt, Artificial Sequence
  Description of Artificial Sequence: Synthetic oligonucleotide
agcuuugucuagggucaguc

SEQ ID NO: 472 - RNA, 20 nt, Artificial Sequence
  Description of Artificial Sequence: Synthetic oligonucleotide
gagcuuugucuagggucagu

SEQ ID NO: 473 - RNA, 20 nt, Artificial Sequence
  Description of Artificial Sequence: Synthetic oligonucleotide
aagagcuuugucuaggguca

SEQ ID NO: 474 - RNA, 20 nt, Artificial Sequence
  Description of Artificial Sequence: Synthetic oligonucleotide
caagagcuuugucuaggguc

SEQ ID NO: 475 - RNA, 20 nt, Artificial Sequence
  Description of Artificial Sequence: Synthetic oligonucleotide
ucaagagcuuugucuagggu

SEQ ID NO: 476 - RNA, 20 nt, Artificial Sequence
  Description of Artificial Sequence: Synthetic oligonucleotide
ugucaagagcuuugucuagg

SEQ ID NO: 477 - RNA, 20 nt, Artificial Sequence
  Description of Artificial Sequence: Synthetic oligonucleotide
augucaagagcuuugucuag

SEQ ID NO: 478 - RNA, 20 nt, Artificial Sequence
  Description of Artificial Sequence: Synthetic oligonucleotide
caugucaagagcuuugucua

SEQ ID NO: 479 - RNA, 20 nt, Artificial Sequence
  Description of Artificial Sequence: Synthetic oligonucleotide
gucaugucaagagcuuuguc

SEQ ID NO: 480 - RNA, 20 nt, Artificial Sequence
  Description of Artificial Sequence: Synthetic oligonucleotide
aagucaugucaagagcuuug

SEQ ID NO: 481 - RNA, 20 nt, Artificial Sequence
  Description of Artificial Sequence: Synthetic oligonucleotide
guaagucaugucaagagcuu

SEQ ID NO: 482 - RNA, 20 nt, Artificial Sequence
  Description of Artificial Sequence: Synthetic oligonucleotide
aguaagucaugucaagagcu

SEQ ID NO: 483 - RNA, 20 nt, Artificial Sequence
  Description of Artificial Sequence: Synthetic oligonucleotide
uaguaagucaugucaagagc

SEQ ID NO: 484 - RNA, 20 nt, Artificial Sequence
  Description of Artificial Sequence: Synthetic oligonucleotide
guaguaagucaugucaagag

SEQ ID NO: 485 - RNA, 20 nt, Artificial Sequence
  Description of Artificial Sequence: Synthetic oligonucleotide
gguaguaagucaugucaaga

SEQ ID NO: 486 - RNA, 20 nt, Artificial Sequence
  Description of Artificial Sequence: Synthetic oligonucleotide
agguaguaagucaugucaag

SEQ ID NO: 487 - RNA, 20 nt, Artificial Sequence
  Description of Artificial Sequence: Synthetic oligonucleotide
ggagguaguaagucauguca

SEQ ID NO: 488 - RNA, 20 nt, Artificial Sequence
  Description of Artificial Sequence: Synthetic oligonucleotide
uggagguaguaagucauguc

SEQ ID NO: 489 - RNA, 20 nt, Artificial Sequence
  Description of Artificial Sequence: Synthetic oligonucleotide
uuggagguaguaagucaugu

SEQ ID NO: 490 - RNA, 20 nt, Artificial Sequence
  Description of Artificial Sequence: Synthetic oligonucleotide
guuggagguaguaagucaug

SEQ ID NO: 491 - RNA, 20 nt, Artificial Sequence
  Description of Artificial Sequence: Synthetic oligonucleotide
uguuggagguaguaagucau

SEQ ID NO: 492 - RNA, 20 nt, Artificial Sequence
  Description of Artificial Sequence: Synthetic oligonucleotide
agaccuucgagaagugcggg

SEQ ID NO: 493 - RNA, 20 nt, Artificial Sequence
  Description of Artificial Sequence: Synthetic oligonucleotide
cagaccuucgagaagugcgg

SEQ ID NO: 494 - RNA, 20 nt, Artificial Sequence
  Description of Artificial Sequence: Synthetic oligonucleotide
acucagaccuucgagaagug

SEQ ID NO: 495 - RNA, 20 nt, Artificial Sequence
  Description of Artificial Sequence: Synthetic oligonucleotide
aacucagaccuucgagaagu

SEQ ID NO: 496 - RNA, 20 nt, Artificial Sequence
  Description of Artificial Sequence: Synthetic oligonucleotide
uaacucagaccuucgagaag

SEQ ID NO: 497 - RNA, 20 nt, Artificial Sequence
  Description of Artificial Sequence: Synthetic oligonucleotide
guaacucagaccuucgagaa

SEQ ID NO: 498 - RNA, 20 nt, Artificial Sequence
  Description of Artificial Sequence: Synthetic oligonucleotide
aguaacucagaccuucgaga

SEQ ID NO: 499 - RNA, 20 nt, Artificial Sequence
  Description of Artificial Sequence: Synthetic oligonucleotide
uccaaguaacucagaccuuc

SEQ ID NO: 500 - RNA, 20 nt, Artificial Sequence
  Description of Artificial Sequence: Synthetic oligonucleotide
uuccaaguaacucagaccuu

SEQ ID NO: 501 - RNA, 20 nt, Artificial Sequence
  Description of Artificial Sequence: Synthetic oligonucleotide
gauuccaaguaacucagacc

SEQ ID NO: 502 - RNA, 20 nt, Artificial Sequence
  Description of Artificial Sequence: Synthetic oligonucleotide
cgauuccaaguaacucagac

SEQ ID NO: 503 - RNA, 20 nt, Artificial Sequence
  Description of Artificial Sequence: Synthetic oligonucleotide
gugguaaaacgauuccaagu

SEQ ID NO: 504 - RNA, 20 nt, Artificial Sequence
  Description of Artificial Sequence: Synthetic oligonucleotide
ugugguaaaacgauuccaag

SEQ ID NO: 505 - RNA, 20 nt, Artificial Sequence
  Description of Artificial Sequence: Synthetic oligonucleotide
caugugguaaaacgauucca

SEQ ID NO: 506 - RNA, 20 nt, Artificial Sequence
  Description of Artificial Sequence: Synthetic oligonucleotide
ucaugugguaaaacgauucc

SEQ ID NO: 507 - RNA, 20 nt, Artificial Sequence
  Description of Artificial Sequence: Synthetic oligonucleotide
ccaucaugugguaaaacgau

SEQ ID NO: 508 - RNA, 20 nt, Artificial Sequence
  Description of Artificial Sequence: Synthetic oligonucleotide
cuguccaucaugugguaaaa

SEQ ID NO: 509 - RNA, 20 nt, Artificial Sequence
  Description of Artificial Sequence: Synthetic oligonucleotide
ucuguccaucaugugguaaa

SEQ ID NO: 510 - RNA, 20 nt, Artificial Sequence
  Description of Artificial Sequence: Synthetic oligonucleotide
uucuguccaucaugugguaa

SEQ ID NO: 511 - RNA, 20 nt, Artificial Sequence
  Description of Artificial Sequence: Synthetic oligonucleotide
ccuucuguccaucauguggu

SEQ ID NO: 512 - RNA, 20 nt, Artificial Sequence
  Description of Artificial Sequence: Synthetic oligonucleotide
cgcuugagguuuucagagau

SEQ ID NO: 513 - RNA, 20 nt, Artificial Sequence
  Description of Artificial Sequence: Synthetic oligonucleotide
aacgcuugagguuuucagag

SEQ ID NO: 514 - RNA, 20 nt, Artificial Sequence
  Description of Artificial Sequence: Synthetic oligonucleotide
uaacgcuugagguuuucaga

SEQ ID NO: 515 - RNA, 20 nt, Artificial Sequence
  Description of Artificial Sequence: Synthetic oligonucleotide
guaacgcuugagguuuucag

SEQ ID NO: 516 - RNA, 20 nt, Artificial Sequence
  Description of Artificial Sequence: Synthetic oligonucleotide
gguaacgcuugagguuuuca

SEQ ID NO: 517 - RNA, 20 nt, Artificial Sequence
  Description of Artificial Sequence: Synthetic oligonucleotide
agguaacgcuugagguuuuc

SEQ ID NO: 518 - RNA, 20 nt, Artificial Sequence
  Description of Artificial Sequence: Synthetic oligonucleotide
aagguaacgcuugagguuuu

SEQ ID NO: 519 - RNA, 20 nt, Artificial Sequence
  Description of Artificial Sequence: Synthetic oligonucleotide
gaagguaacgcuugagguuu

SEQ ID NO: 520 - RNA, 20 nt, Artificial Sequence
  Description of Artificial Sequence: Synthetic oligonucleotide
agaagguaacgcuugagguu

SEQ ID NO: 521 - RNA, 20 nt, Artificial Sequence
  Description of Artificial Sequence: Synthetic oligonucleotide
aagaagguaacgcuugaggu

SEQ ID NO: 522 - RNA, 20 nt, Artificial Sequence
  Description of Artificial Sequence: Synthetic oligonucleotide
gaagaagguaacgcuugagg

SEQ ID NO: 523 - RNA, 20 nt, Artificial Sequence
  Description of Artificial Sequence: Synthetic oligonucleotide
ugaagaagguaacgcuugag

SEQ ID NO: 524 - RNA, 20 nt, Artificial Sequence
  Description of Artificial Sequence: Synthetic oligonucleotide
cugaagaagguaacgcuuga

SEQ ID NO: 525 - RNA, 20 nt, Artificial Sequence
  Description of Artificial Sequence: Synthetic oligonucleotide
acugaagaagguaacgcuug

SEQ ID NO: 526 - RNA, 20 nt, Artificial Sequence
  Description of Artificial Sequence: Synthetic oligonucleotide
uacugaagaagguaacgcuu

SEQ ID NO: 527 - RNA, 20 nt, Artificial Sequence
  Description of Artificial Sequence: Synthetic oligonucleotide
cugucaaucacuggcuuaaa

SEQ ID NO: 528 - RNA, 20 nt, Artificial Sequence
  Description of Artificial Sequence: Synthetic oligonucleotide
ccugucaaucacuggcuuaa

SEQ ID NO: 529 - RNA, 20 nt, Artificial Sequence
  Description of Artificial Sequence: Synthetic oligonucleotide
gccugucaaucacuggcuua

SEQ ID NO: 530 - RNA, 20 nt, Artificial Sequence
  Description of Artificial Sequence: Synthetic oligonucleotide
ugccugucaaucacuggcuu

SEQ ID NO: 531 - RNA, 20 nt, Artificial Sequence
  Description of Artificial Sequence: Synthetic oligonucleotide
uugccugucaaucacuggcu

SEQ ID NO: 532 - RNA, 20 nt, Artificial Sequence
  Description of Artificial Sequence: Synthetic oligonucleotide
uuugccugucaaucacuggc

SEQ ID NO: 533 - RNA, 20 nt, Artificial Sequence
  Description of Artificial Sequence: Synthetic oligonucleotide
gcuuugccugucaaucacug

SEQ ID NO: 534 - RNA, 20 nt, Artificial Sequence
  Description of Artificial Sequence: Synthetic oligonucleotide
agcuuugccugucaaucacu

SEQ ID NO: 535 - RNA, 20 nt, Artificial Sequence
  Description of Artificial Sequence: Synthetic oligonucleotide
cagcuuugccugucaaucac

SEQ ID NO: 536 - RNA, 20 nt, Artificial Sequence
  Description of Artificial Sequence: Synthetic oligonucleotide
ccagcuuugccugucaauca

SEQ ID NO: 537 - RNA, 20 nt, Artificial Sequence
  Description of Artificial Sequence: Synthetic oligonucleotide
uccagcuuugccugucaauc

SEQ ID NO: 538 - RNA, 20 nt, Artificial Sequence
  Description of Artificial Sequence: Synthetic oligonucleotide
cuccagcuuugccugucaau

SEQ ID NO: 539 - RNA, 20 nt, Artificial Sequence
  Description of Artificial Sequence: Synthetic oligonucleotide
cacuccagcuuugccuguca

SEQ ID NO: 540 - RNA, 20 nt, Artificial Sequence
  Description of Artificial Sequence: Synthetic oligonucleotide
ucacuccagcuuugccuguc

SEQ ID NO: 541 - RNA, 20 nt, Artificial Sequence
  Description of Artificial Sequence: Synthetic oligonucleotide
uugucacuccagcuuugccu

SEQ ID NO: 542 - RNA, 20 nt, Artificial Sequence
  Description of Artificial Sequence: Synthetic oligonucleotide
cuugucacuccagcuuugcc

SEQ ID NO: 543 - RNA, 20 nt, Artificial Sequence
  Description of Artificial Sequence: Synthetic oligonucleotide
agcauccugucccagacuga

SEQ ID NO: 544 - RNA, 20 nt, Artificial Sequence
  Description of Artificial Sequence: Synthetic oligonucleotide
ucacaggccagcuucaagag

SEQ ID NO: 545 - RNA, 20 nt, Artificial Sequence
  Description of Artificial Sequence: Synthetic oligonucleotide
ggucacaggccagcuucaag

SEQ ID NO: 546 - RNA, 20 nt, Artificial Sequence
  Description of Artificial Sequence: Synthetic oligonucleotide
aggucacaggccagcuucaa

SEQ ID NO: 547 - RNA, 20 nt, Artificial Sequence
  Description of Artificial Sequence: Synthetic oligonucleotide
ucaggucacaggccagcuuc

SEQ ID NO: 548 - RNA, 20 nt, Artificial Sequence
  Description of Artificial Sequence: Synthetic oligonucleotide
guucaggucacaggccagcu

SEQ ID NO: 549 - RNA, 20 nt, Artificial Sequence
  Description of Artificial Sequence: Synthetic oligonucleotide
ugguucaggucacaggccag

SEQ ID NO: 550 - RNA, 20 nt, Artificial Sequence
  Description of Artificial Sequence: Synthetic oligonucleotide
augguucaggucacaggcca

SEQ ID NO: 551 - RNA, 20 nt, Artificial Sequence
  Description of Artificial Sequence: Synthetic oligonucleotide
caugguucaggucacaggcc

SEQ ID NO: 552 - RNA, 20 nt, Artificial Sequence
  Description of Artificial Sequence: Synthetic oligonucleotide
gagcaugguucaggucacag

SEQ ID NO: 553 - RNA, 20 nt, Artificial Sequence
  Description of Artificial Sequence: Synthetic oligonucleotide
ggagcaugguucaggucaca

SEQ ID NO: 554 - RNA, 20 nt, Artificial Sequence
  Description of Artificial Sequence: Synthetic oligonucleotide
caaggagcaugguucagguc

SEQ ID NO: 555 - RNA, 20 nt, Artificial Sequence
  Description of Artificial Sequence: Synthetic oligonucleotide
gcaaggagcaugguucaggu

SEQ ID NO: 556 - RNA, 20 nt, Artificial Sequence
  Description of Artificial Sequence: Synthetic oligonucleotide
ugcaaggagcaugguucagg

SEQ ID NO: 557 - RNA, 20 nt, Artificial Sequence
  Description of Artificial Sequence: Synthetic oligonucleotide
cuuucuggaugcaaggagca

SEQ ID NO: 558 - RNA, 20 nt, Artificial Sequence
  Description of Artificial Sequence: Synthetic oligonucleotide
gcuuucuggaugcaaggagc

SEQ ID NO: 559 - RNA, 20 nt, Artificial Sequence
  Description of Artificial Sequence: Synthetic oligonucleotide
gcagcuuucuggaugcaagg

SEQ ID NO: 560 - RNA, 20 nt, Artificial Sequence
  Description of Artificial Sequence: Synthetic oligonucleotide
agcagcuuucuggaugcaag

SEQ ID NO: 561 - RNA, 20 nt, Artificial Sequence
  Description of Artificial Sequence: Synthetic oligonucleotide
cagcagcuuucuggaugcaa

SEQ ID NO: 562 - RNA, 20 nt, Artificial Sequence
  Description of Artificial Sequence: Synthetic oligonucleotide
ucagcagcuuucuggaugca

SEQ ID NO: 563 - RNA, 20 nt, Artificial Sequence
  Description of Artificial Sequence: Synthetic oligonucleotide
gaguucagcagcuuucugga

SEQ ID NO: 564 - RNA, 20 nt, Artificial Sequence
  Description of Artificial Sequence: Synthetic oligonucleotide
aagaguucagcagcuuucug

SEQ ID NO: 565 - RNA, 20 nt, Artificial Sequence
  Description of Artificial Sequence: Synthetic oligonucleotide
agaagaguucagcagcuuuc

SEQ ID NO: 566 - RNA, 20 nt, Artificial Sequence
  Description of Artificial Sequence: Synthetic oligonucleotide
gagaagaguucagcagcuuu

SEQ ID NO: 567 - RNA, 20 nt, Artificial Sequence
  Description of Artificial Sequence: Synthetic oligonucleotide
ugagcacccacagaauacac

SEQ ID NO: 568 - RNA, 20 nt, Artificial Sequence
  Description of Artificial Sequence: Synthetic oligonucleotide
uguugucugagcacccacag

SEQ ID NO: 569 - RNA, 20 nt, Artificial Sequence
  Description of Artificial Sequence: Synthetic oligonucleotide
cuguugucugagcacccaca

SEQ ID NO: 570 - RNA, 20 nt, Artificial Sequence
  Description of Artificial Sequence: Synthetic oligonucleotide
gcuguugucugagcacccac

SEQ ID NO: 571 - RNA, 20 nt, Artificial Sequence
  Description of Artificial Sequence: Synthetic oligonucleotide
aaaagguaauuccauccugc

SEQ ID NO: 572 - RNA, 20 nt, Artificial Sequence
  Description of Artificial Sequence: Synthetic oligonucleotide
cacuugacauugacaguuca

SEQ ID NO: 573 - RNA, 20 nt, Artificial Sequence
  Description of Artificial Sequence: Synthetic oligonucleotide
gcacuugacauugacaguuc

SEQ ID NO: 574 - RNA, 20 nt, Artificial Sequence
  Description of Artificial Sequence: Synthetic oligonucleotide
agcacuugacauugacaguu

SEQ ID NO: 575 - RNA, 20 nt, Artificial Sequence
  Description of Artificial Sequence: Synthetic oligonucleotide
uucagcacuugacauugaca

SEQ ID NO: 576 - RNA, 20 nt, Artificial Sequence
  Description of Artificial Sequence: Synthetic oligonucleotide
uguucagcacuugacauuga

SEQ ID NO: 577 - RNA, 20 nt, Artificial Sequence
  Description of Artificial Sequence: Synthetic oligonucleotide
uuguucagcacuugacauug

SEQ ID NO: 578 - RNA, 20 nt, Artificial Sequence
  Description of Artificial Sequence: Synthetic oligonucleotide
cucguugacaaagcauacag

SEQ ID NO: 579 - RNA, 20 nt, Artificial Sequence
  Description of Artificial Sequence: Synthetic oligonucleotide
gcucguugacaaagcauaca

SEQ ID NO: 580 - RNA, 20 nt, Artificial Sequence
  Description of Artificial Sequence: Synthetic oligonucleotide
augcuugcucguugacaaag

SEQ ID NO: 581 - RNA, 20 nt, Artificial Sequence
  Description of Artificial Sequence: Synthetic oligonucleotide
gaugcuugcucguugacaaa

SEQ ID NO: 582 - RNA, 20 nt, Artificial Sequence
  Description of Artificial Sequence: Synthetic oligonucleotide
ugaugcuugcucguugacaa

SEQ ID NO: 583 - RNA, 20 nt, Artificial Sequence
  Description of Artificial Sequence: Synthetic oligonucleotide
cugaugcuugcucguugaca

SEQ ID NO: 584 - RNA, 20 nt, Artificial Sequence
  Description of Artificial Sequence: Synthetic oligonucleotide
ccugaugcuugcucguugac

SEQ ID NO: 585 - RNA, 20 nt, Artificial Sequence
  Description of Artificial Sequence: Synthetic oligonucleotide
uccugaugcuugcucguuga

SEQ ID NO: 586 - RNA, 20 nt, Artificial Sequence
  Description of Artificial Sequence: Synthetic oligonucleotide
uuccugaugcuugcucguug

SEQ ID NO: 587 - RNA, 20 nt, Artificial Sequence
  Description of Artificial Sequence: Synthetic oligonucleotide
uuuccugaugcuugcucguu

SEQ ID NO: 588 - RNA, 20 nt, Artificial Sequence
  Description of Artificial Sequence: Synthetic oligonucleotide
uuuuccugaugcuugcucgu

SEQ ID NO: 589 - RNA, 20 nt, Artificial Sequence
  Description of Artificial Sequence: Synthetic oligonucleotide
cuuuuccugaugcuugcucg

SEQ ID NO: 590 - RNA, 20 nt, Artificial Sequence
  Description of Artificial Sequence: Synthetic oligonucleotide
cuugauaaccuuuccuucca

SEQ ID NO: 591 - RNA, 20 nt, Artificial Sequence
  Description of Artificial Sequence: Synthetic oligonucleotide
ucuugauaaccuuuccuucc

SEQ ID NO: 592 - RNA, 20 nt, Artificial Sequence
  Description of Artificial Sequence: Synthetic oligonucleotide
gucuugauaaccuuuccuuc

SEQ ID NO: 593 - RNA, 20 nt, Artificial Sequence
  Description of Artificial Sequence: Synthetic oligonucleotide
gugucuugauaaccuuuccu

SEQ ID NO: 594 - RNA, 20 nt, Artificial Sequence
  Description of Artificial Sequence: Synthetic oligonucleotide
guucugugucuugauaaccu

SEQ ID NO: 595 - RNA, 20 nt, Artificial Sequence
  Description of Artificial Sequence: Synthetic oligonucleotide
gcugccaaguucugugucuu

SEQ ID NO: 596 - RNA, 20 nt, Artificial Sequence
  Description of Artificial Sequence: Synthetic oligonucleotide
agcugccaaguucugugucu

SEQ ID NO: 597 - RNA, 20 nt, Artificial Sequence
  Description of Artificial Sequence: Synthetic oligonucleotide
agagcugccaaguucugugu

SEQ ID NO: 598 - RNA, 20 nt, Artificial Sequence
  Description of Artificial Sequence: Synthetic oligonucleotide
ggagagcugccaaguucugu

SEQ ID NO: 599 - RNA, 20 nt, Artificial Sequence
  Description of Artificial Sequence: Synthetic oligonucleotide
aaggagagcugccaaguucu

SEQ ID NO: 600 - RNA, 20 nt, Artificial Sequence
  Description of Artificial Sequence: Synthetic oligonucleotide
gaaggagagcugccaaguuc

SEQ ID NO: 601 - RNA, 20 nt, Artificial Sequence
  Description of Artificial Sequence: Synthetic oligonucleotide
augaaggagagcugccaagu

SEQ ID NO: 602 - RNA, 20 nt, Artificial Sequence
  Description of Artificial Sequence: Synthetic oligonucleotide
caugaaggagagcugccaag

SEQ ID NO: 603 - RNA, 20 nt, Artificial Sequence
  Description of Artificial Sequence: Synthetic oligonucleotide
gcaugaaggagagcugccaa

SEQ ID NO: 604 - RNA, 20 nt, Artificial Sequence
  Description of Artificial Sequence: Synthetic oligonucleotide
cgcaugaaggagagcugcca

SEQ ID NO: 605 - RNA, 20 nt, Artificial Sequence
  Description of Artificial Sequence: Synthetic oligonucleotide
ucgcaugaaggagagcugcc

SEQ ID NO: 606 - RNA, 20 nt, Artificial Sequence
  Description of Artificial Sequence: Synthetic oligonucleotide
aucgcaugaaggagagcugc

SEQ ID NO: 607 - RNA, 20 nt, Artificial Sequence
  Description of Artificial Sequence: Synthetic oligonucleotide
caaucgcaugaaggagagcu

SEQ ID NO: 608 - RNA, 20 nt, Artificial Sequence
  Description of Artificial Sequence: Synthetic oligonucleotide
gcaaucgcaugaaggagagc

SEQ ID NO: 609 - RNA, 20 nt, Artificial Sequence
  Description of Artificial Sequence: Synthetic oligonucleotide
ggcaaucgcaugaaggagag

SEQ ID NO: 610 - RNA, 20 nt, Artificial Sequence
  Description of Artificial Sequence: Synthetic oligonucleotide
cuggcaaucgcaugaaggag

SEQ ID NO: 611 - RNA, 20 nt, Artificial Sequence
  Description of Artificial Sequence: Synthetic oligonucleotide
ucuggcaaucgcaugaagga

SEQ ID NO: 612 - RNA, 20 nt, Artificial Sequence
  Description of Artificial Sequence: Synthetic oligonucleotide
gucuggcaaucgcaugaagg

SEQ ID NO: 613 - RNA, 20 nt, Artificial Sequence
  Description of Artificial Sequence: Synthetic oligonucleotide
cgucuggcaaucgcaugaag

SEQ ID NO: 614 - RNA, 20 nt, Artificial Sequence
  Description of Artificial Sequence: Synthetic oligonucleotide
acgucuggcaaucgcaugaa

SEQ ID NO: 615 - RNA, 20 nt, Artificial Sequence
  Description of Artificial Sequence: Synthetic oligonucleotide
ucucuuacaaaaucccaugc

SEQ ID NO: 616 - RNA, 20 nt, Artificial Sequence
  Description of Artificial Sequence: Synthetic oligonucleotide
agaagauggguccaauuuuc

SEQ ID NO: 617 - RNA, 20 nt, Artificial Sequence
  Description of Artificial Sequence: Synthetic oligonucleotide
cagaagauggguccaauuuu

SEQ ID NO: 618 - RNA, 20 nt, Artificial Sequence
  Description of Artificial Sequence: Synthetic oligonucleotide
ucagaagauggguccaauuu

SEQ ID NO: 619 - RNA, 20 nt, Artificial Sequence
  Description of Artificial Sequence: Synthetic oligonucleotide
uucagaagauggguccaauu

SEQ ID NO: 620 - RNA, 20 nt, Artificial Sequence
  Description of Artificial Sequence: Synthetic oligonucleotide
aagugagcuguugugccaga

SEQ ID NO: 621 - RNA, 20 nt, Artificial Sequence
  Description of Artificial Sequence: Synthetic oligonucleotide
agaaaagugagcuguugugc

SEQ ID NO: 622 - RNA, 20 nt, Artificial Sequence
  Description of Artificial Sequence: Synthetic oligonucleotide
gaagaaaagugagcuguugu

SEQ ID NO: 623 - RNA, 20 nt, Artificial Sequence
  Description of Artificial Sequence: Synthetic oligonucleotide
gagccucaagagauucaaaa

SEQ ID NO: 624 - RNA, 20 nt, Artificial Sequence
  Description of Artificial Sequence: Synthetic oligonucleotide
ugagccucaagagauucaaa

SEQ ID NO: 625 - RNA, 20 nt, Artificial Sequence
  Description of Artificial Sequence: Synthetic oligonucleotide
cagaugugauccuugagccu

SEQ ID NO: 626 - RNA, 20 nt, Artificial Sequence
  Description of Artificial Sequence: Synthetic oligonucleotide
ccagaugugauccuugagcc

SEQ ID NO: 627 - RNA, 20 nt, Artificial Sequence
  Description of Artificial Sequence: Synthetic oligonucleotide
uccagaugugauccuugagc

SEQ ID NO: 628 - RNA, 20 nt, Artificial Sequence
  Description of Artificial Sequence: Synthetic oligonucleotide
guuaucguuuccagaacagu

SEQ ID NO: 629 - RNA, 20 nt, Artificial Sequence
  Description of Artificial Sequence: Synthetic oligonucleotide
gguuaucguuuccagaacag

SEQ ID NO: 630 - RNA, 20 nt, Artificial Sequence
  Description of Artificial Sequence: Synthetic oligonucleotide
ugguuaucguuuccagaaca

SEQ ID NO: 631 - RNA, 20 nt, Artificial Sequence
  Description of Artificial Sequence: Synthetic oligonucleotide
uugguuaucguuuccagaac

SEQ ID NO: 632 - RNA, 20 nt, Artificial Sequence
  Description of Artificial Sequence: Synthetic oligonucleotide
uaaccauuagccaaguccuc

SEQ ID NO: 633 - RNA, 20 nt, Artificial Sequence
  Description of Artificial Sequence: Synthetic oligonucleotide
uuaaccauuagccaaguccu

SEQ ID NO: 634 - RNA, 20 nt, Artificial Sequence
  Description of Artificial Sequence: Synthetic oligonucleotide
auuaaccauuagccaagucc

SEQ ID NO: 635 - RNA, 20 nt, Artificial Sequence
  Description of Artificial Sequence: Synthetic oligonucleotide
auuacaggcgugagccaccg

SEQ ID NO: 636 - RNA, 20 nt, Artificial Sequence
  Description of Artificial Sequence: Synthetic oligonucleotide
gauuacaggcgugagccacc

SEQ ID NO: 637 - RNA, 20 nt, Artificial Sequence
  Description of Artificial Sequence: Synthetic oligonucleotide
ggauuacaggcgugagccac

SEQ ID NO: 638 - RNA, 20 nt, Artificial Sequence
  Description of Artificial Sequence: Synthetic oligonucleotide
gggauuacaggcgugagcca

SEQ ID NO: 639 - RNA, 20 nt, Artificial Sequence
  Description of Artificial Sequence: Synthetic oligonucleotide
ugggauuacaggcgugagcc

SEQ ID NO: 640 - RNA, 20 nt, Artificial Sequence
  Description of Artificial Sequence: Synthetic oligonucleotide
cugggauuacaggcgugagc

SEQ ID NO: 641 - RNA, 20 nt, Artificial Sequence
  Description of Artificial Sequence: Synthetic oligonucleotide
gcugggauuacaggcgugag

SEQ ID NO: 642 - RNA, 20 nt, Artificial Sequence
  Description of Artificial Sequence: Synthetic oligonucleotide
ugcugggauuacaggcguga

SEQ ID NO: 643 - RNA, 20 nt, Artificial Sequence
  Description of Artificial Sequence: Synthetic oligonucleotide
gugcugggauuacaggcgug

SEQ ID NO: 644 - RNA, 20 nt, Artificial Sequence
  Description of Artificial Sequence: Synthetic oligonucleotide
agugcugggauuacaggcgu

SEQ ID NO: 645 - RNA, 20 nt, Artificial Sequence
  Description of Artificial Sequence: Synthetic oligonucleotide
aagugcugggauuacaggcg

SEQ ID NO: 646 - RNA, 20 nt, Artificial Sequence
  Description of Artificial Sequence: Synthetic oligonucleotide
aaagugcugggauuacaggc

SEQ ID NO: 647 - RNA, 20 nt, Artificial Sequence
  Description of Artificial Sequence: Synthetic oligonucleotide
caaagugcugggauuacagg

SEQ ID NO: 648 - RNA, 20 nt, Artificial Sequence
  Description of Artificial Sequence: Synthetic oligonucleotide
ccaaagugcugggauuacag

SEQ ID NO: 649 - RNA, 20 nt, Artificial Sequence
  Description of Artificial Sequence: Synthetic oligonucleotide
ucucagccucccaaagugcu

SEQ ID NO: 650 - RNA, 20 nt, Artificial Sequence
  Description of Artificial Sequence: Synthetic oligonucleotide
uucucagccucccaaagugc

SEQ ID NO: 651 - RNA, 20 nt, Artificial Sequence
  Description of Artificial Sequence: Synthetic oligonucleotide
cuucucagccucccaaagug

SEQ ID NO: 652 - RNA, 20 nt, Artificial Sequence
  Description of Artificial Sequence: Synthetic oligonucleotide
ccuucucagccucccaaagu

SEQ ID NO: 653 - RNA, 20 nt, Artificial Sequence
  Description of Artificial Sequence: Synthetic oligonucleotide
cccuucucagccucccaaag

SEQ ID NO: 654 - RNA, 20 nt, Artificial Sequence
  Description of Artificial Sequence: Synthetic oligonucleotide
aucuccugaccucgugaucc

SEQ ID NO: 655 - RNA, 20 nt, Artificial Sequence
  Description of Artificial Sequence: Synthetic oligonucleotide
caucuccugaccucgugauc

SEQ ID NO: 656 - RNA, 20 nt, Artificial Sequence
  Description of Artificial Sequence: Synthetic oligonucleotide
ccaucuccugaccucgugau

SEQ ID NO: 657 - RNA, 20 nt, Artificial Sequence
  Description of Artificial Sequence: Synthetic oligonucleotide
uccaucuccugaccucguga

SEQ ID NO: 658 - RNA, 20 nt, Artificial Sequence
  Description of Artificial Sequence: Synthetic oligonucleotide
cuccaucuccugaccucgug

SEQ ID NO: 659 - RNA, 20 nt, Artificial Sequence
  Description of Artificial Sequence: Synthetic oligonucleotide
ucuccaucuccugaccucgu

SEQ ID NO: 660 - RNA, 20 nt, Artificial Sequence
  Description of Artificial Sequence: Synthetic oligonucleotide
cucaccguguuagccaggau

SEQ ID NO: 661 - RNA, 20 nt, Artificial Sequence
  Description of Artificial Sequence: Synthetic oligonucleotide
ucucaccguguuagccagga

SEQ ID NO: 662 - RNA, 20 nt, Artificial Sequence
  Description of Artificial Sequence: Synthetic oligonucleotide
gucucaccguguuagccagg

SEQ ID NO: 663 - RNA, 20 nt, Artificial Sequence
  Description of Artificial Sequence: Synthetic oligonucleotide
ggucucaccguguuagccag

SEQ ID NO: 664 - RNA, 20 nt, Artificial Sequence
  Description of Artificial Sequence: Synthetic oligonucleotide
gggucucaccguguuagcca

SEQ ID NO: 665 - RNA, 20 nt, Artificial Sequence
  Description of Artificial Sequence: Synthetic oligonucleotide
uacaggcaccugccaccaug

SEQ ID NO: 666 - RNA, 20 nt, Artificial Sequence
  Description of Artificial Sequence: Synthetic oligonucleotide
cuacaggcaccugccaccau

SEQ ID NO: 667 - RNA, 20 nt, Artificial Sequence
  Description of Artificial Sequence: Synthetic oligonucleotide
acuacaggcaccugccacca

SEQ ID NO: 668 - RNA, 20 nt, Artificial Sequence
  Description of Artificial Sequence: Synthetic oligonucleotide
agcugggacuacaggcaccu

SEQ ID NO: 669 - RNA, 20 nt, Artificial Sequence
  Description of Artificial Sequence: Synthetic oligonucleotide
uagcugggacuacaggcacc

SEQ ID NO: 670 - RNA, 20 nt, Artificial Sequence
  Description of Artificial Sequence: Synthetic oligonucleotide
cugccgaguagcugggacua

SEQ ID NO: 671 - RNA, 20 nt, Artificial Sequence
  Description of Artificial Sequence: Synthetic oligonucleotide
cucacugcaagcuccaccuc

SEQ ID NO: 672 - RNA, 20 nt, Artificial Sequence
  Description of Artificial Sequence: Synthetic oligonucleotide
gcucacugcaagcuccaccu

SEQ ID NO: 673 - RNA, 20 nt, Artificial Sequence
  Description of Artificial Sequence: Synthetic oligonucleotide
ucggcucacugcaagcucca

SEQ ID NO: 674 - RNA, 20 nt, Artificial Sequence
  Description of Artificial Sequence: Synthetic oligonucleotide
ucucggcucacugcaagcuc

SEQ ID NO: 675 - RNA, 20 nt, Artificial Sequence
  Description of Artificial Sequence: Synthetic oligonucleotide
aucucggcucacugcaagcu

SEQ ID NO: 676 - RNA, 20 nt, Artificial Sequence
  Description of Artificial Sequence: Synthetic oligonucleotide
aaucucggcucacugcaagc

SEQ ID NO: 677 - RNA, 20 nt, Artificial Sequence
  Description of Artificial Sequence: Synthetic oligonucleotide
caaucucggcucacugcaag

SEQ ID NO: 678 - RNA, 20 nt, Artificial Sequence
  Description of Artificial Sequence: Synthetic oligonucleotide
gcaaucucggcucacugcaa

SEQ ID NO: 679 - RNA, 20 nt, Artificial Sequence
  Description of Artificial Sequence: Synthetic oligonucleotide
gugcaaucucggcucacugc

SEQ ID NO: 680 - RNA, 20 nt, Artificial Sequence
  Description of Artificial Sequence: Synthetic oligonucleotide
ggugcaaucucggcucacug

SEQ ID NO: 681 - RNA, 20 nt, Artificial Sequence
  Description of Artificial Sequence: Synthetic oligonucleotide
uggugcaaucucggcucacu

SEQ ID NO: 682 - RNA, 20 nt, Artificial Sequence
  Description of Artificial Sequence: Synthetic oligonucleotide
guggugcaaucucggcucac

SEQ ID NO: 683 - RNA, 20 nt, Artificial Sequence
  Description of Artificial Sequence: Synthetic oligonucleotide
aguggugcaaucucggcuca

SEQ ID NO: 684 - RNA, 20 nt, Artificial Sequence
  Description of Artificial Sequence: Synthetic oligonucleotide
caguggugcaaucucggcuc

SEQ ID NO: 685 - RNA, 20 nt, Artificial Sequence
  Description of Artificial Sequence: Synthetic oligonucleotide
gcaguggugcaaucucggcu

SEQ ID NO: 686 - RNA, 20 nt, Artificial Sequence
  Description of Artificial Sequence: Synthetic oligonucleotide
aggcuggaaugcaguggugc

SEQ ID NO: 687 - RNA, 20 nt, Artificial Sequence
  Description of Artificial Sequence: Synthetic oligonucleotide
caggcuggaaugcaguggug

SEQ ID NO: 688 - RNA, 20 nt, Artificial Sequence
  Description of Artificial Sequence: Synthetic oligonucleotide
ccaggcuggaaugcaguggu

SEQ ID NO: 689 - RNA, 20 nt, Artificial Sequence
  Description of Artificial Sequence: Synthetic oligonucleotide
acccaggcuggaaugcagug

SEQ ID NO: 690 - RNA, 20 nt, Artificial Sequence
  Description of Artificial Sequence: Synthetic oligonucleotide
cacccaggcuggaaugcagu

SEQ ID NO: 691 - RNA, 20 nt, Artificial Sequence
  Description of Artificial Sequence: Synthetic oligonucleotide
ucacccaggcuggaaugcag

SEQ ID NO: 692 - RNA, 20 nt, Artificial Sequence
  Description of Artificial Sequence: Synthetic oligonucleotide
gucacccaggcuggaaugca

SEQ ID NO: 693 - RNA, 20 nt, Artificial Sequence
  Description of Artificial Sequence: Synthetic oligonucleotide
agucacccaggcuggaaugc

SEQ ID NO: 694 - RNA, 20 nt, Artificial Sequence
  Description of Artificial Sequence: Synthetic oligonucleotide
cagucacccaggcuggaaug

SEQ ID NO: 695 - RNA, 20 nt, Artificial Sequence
  Description of Artificial Sequence: Synthetic oligonucleotide
ucagucacccaggcuggaau

SEQ ID NO: 696 - RNA, 20 nt, Artificial Sequence
  Description of Artificial Sequence: Synthetic oligonucleotide
cucagucacccaggcuggaa

SEQ ID NO: 697 - RNA, 20 nt, Artificial Sequence
  Description of Artificial Sequence: Synthetic oligonucleotide
gacagagucucgcucaguca

SEQ ID NO: 698 - RNA, 20 nt, Artificial Sequence
  Description of Artificial Sequence: Synthetic oligonucleotide
gucaugucugauguaccuuu

SEQ ID NO: 699 - RNA, 20 nt, Artificial Sequence
  Description of Artificial Sequence: Synthetic oligonucleotide
agucaugucugauguaccuu

SEQ ID NO: 700 - RNA, 20 nt, Artificial Sequence
  Description of Artificial Sequence: Synthetic oligonucleotide
cagucaugucugauguaccu

SEQ ID NO: 701 - RNA, 20 nt, Artificial Sequence
  Description of Artificial Sequence: Synthetic oligonucleotide
gcagucaugucugauguacc

SEQ ID NO: 702 - RNA, 20 nt, Artificial Sequence
  Description of Artificial Sequence: Synthetic oligonucleotide
ggcagucaugucugauguac

SEQ ID NO: 703 - RNA, 20 nt, Artificial Sequence
  Description of Artificial Sequence: Synthetic oligonucleotide
aggcagucaugucugaugua

SEQ ID NO: 704 - RNA, 20 nt, Artificial Sequence
  Description of Artificial Sequence: Synthetic oligonucleotide
caggcagucaugucugaugu

SEQ ID NO: 705 - RNA, 20 nt, Artificial Sequence
  Description of Artificial Sequence: Synthetic oligonucleotide
gcaggcagucaugucugaug

SEQ ID NO: 706 - RNA, 20 nt, Artificial Sequence
  Description of Artificial Sequence: Synthetic oligonucleotide
ugcaggcagucaugucugau

SEQ ID NO: 707 - RNA, 20 nt, Artificial Sequence
  Description of Artificial Sequence: Synthetic oligonucleotide
cuguuugacuucaugcaggc

SEQ ID NO: 708 - RNA, 20 nt, Artificial Sequence
  Description of Artificial Sequence: Synthetic oligonucleotide
uacccuguuugacuucaugc

SEQ ID NO: 709 - RNA, 20 nt, Artificial Sequence
  Description of Artificial Sequence: Synthetic oligonucleotide
guuacccuguuugacuucau

SEQ ID NO: 710 - RNA, 20 nt, Artificial Sequence
  Description of Artificial Sequence: Synthetic oligonucleotide
gguguuacccuguuugacuu

SEQ ID NO: 711 - RNA, 20 nt, Artificial Sequence
  Description of Artificial Sequence: Synthetic oligonucleotide
ugguguuacccuguuugacu

SEQ ID NO: 712 - RNA, 20 nt, Artificial Sequence
  Description of Artificial Sequence: Synthetic oligonucleotide
cugguguuacccuguuugac

SEQ ID NO: 713 - RNA, 20 nt, Artificial Sequence
  Description of Artificial Sequence: Synthetic oligonucleotide
acugguguuacccuguuuga

SEQ ID NO: 714 - RNA, 20 nt, Artificial Sequence
  Description of Artificial Sequence: Synthetic oligonucleotide
cacugguguuacccuguuug

SEQ ID NO: 715 - RNA, 20 nt, Artificial Sequence
  Description of Artificial Sequence: Synthetic oligonucleotide
ucacugguguuacccuguuu

SEQ ID NO: 716 - RNA, 20 nt, Artificial Sequence
  Description of Artificial Sequence: Synthetic oligonucleotide
uucacugguguuacccuguu

SEQ ID NO: 717 - RNA, 20 nt, Artificial Sequence
  Description of Artificial Sequence: Synthetic oligonucleotide
cuucacugguguuacccugu

SEQ ID NO: 718 - RNA, 20 nt, Artificial Sequence
  Description of Artificial Sequence: Synthetic oligonucleotide
agcuucacugguguuacccu

SEQ ID NO: 719 - RNA, 20 nt, Artificial Sequence
  Description of Artificial Sequence: Synthetic oligonucleotide
uugagcuucacugguguuac

SEQ ID NO: 720 - RNA, 20 nt, Artificial Sequence
  Description of Artificial Sequence: Synthetic oligonucleotide
cuugagcuucacugguguua

SEQ ID NO: 721 - RNA, 20 nt, Artificial Sequence
  Description of Artificial Sequence: Synthetic oligonucleotide
acuugagcuucacugguguu

SEQ ID NO: 722 - RNA, 20 nt, Artificial Sequence
  Description of Artificial Sequence: Synthetic oligonucleotide
gacuugagcuucacuggugu

SEQ ID NO: 723 - RNA, 20 nt, Artificial Sequence
  Description of Artificial Sequence: Synthetic oligonucleotide
cucuugacuugagcuucacu

SEQ ID NO: 724 - RNA, 20 nt, Artificial Sequence
  Description of Artificial Sequence: Synthetic oligonucleotide
uccacagcucuugacuugag

SEQ ID NO: 725 - RNA, 20 nt, Artificial Sequence
  Description of Artificial Sequence: Synthetic oligonucleotide
auccacagcucuugacuuga

SEQ ID NO: 726 - RNA, 20 nt, Artificial Sequence
  Description of Artificial Sequence: Synthetic oligonucleotide
uauccacagcucuugacuug

SEQ ID NO: 727 - RNA, 20 nt, Artificial Sequence
  Description of Artificial Sequence: Synthetic oligonucleotide
gacaaaauauccacagcucu

SEQ ID NO: 728 - RNA, 20 nt, Artificial Sequence
  Description of Artificial Sequence: Synthetic oligonucleotide
agacaaaauauccacagcuc

SEQ ID NO: 729 - RNA, 20 nt, Artificial Sequence
  Description of Artificial Sequence: Synthetic oligonucleotide
gacuucuuguugguuagaca

SEQ ID NO: 730 - RNA, 20 nt, Artificial Sequence
  Description of Artificial Sequence: Synthetic oligonucleotide
ugagacuucuuguugguuag

SEQ ID NO: 731 - RNA, 20 nt, Artificial Sequence
  Description of Artificial Sequence: Synthetic oligonucleotide
cuugagacuucuuguugguu

SEQ ID NO: 732 - RNA, 20 nt, Artificial Sequence
  Description of Artificial Sequence: Synthetic oligonucleotide
ucuugagacuucuuguuggu

SEQ ID NO: 733 - RNA, 20 nt, Artificial Sequence
  Description of Artificial Sequence: Synthetic oligonucleotide
uucuugagacuucuuguugg

SEQ ID NO: 734 - RNA, 20 nt, Artificial Sequence
  Description of Artificial Sequence: Synthetic oligonucleotide
gccugauuucuugagacuuc

SEQ ID NO: 735 - RNA, 20 nt, Artificial Sequence
  Description of Artificial Sequence: Synthetic oligonucleotide
ugccugauuucuugagacuu

SEQ ID NO: 736 - RNA, 20 nt, Artificial Sequence
  Description of Artificial Sequence: Synthetic oligonucleotide
caucuuuuggcuggauacga

SEQ ID NO: 737 - RNA, 20 nt, Artificial Sequence
  Description of Artificial Sequence: Synthetic oligonucleotide
gcaucuuuuggcuggauacg

SEQ ID NO: 738 - RNA, 20 nt, Artificial Sequence
  Description of Artificial Sequence: Synthetic oligonucleotide
ccaccacuccaucaucaugc

SEQ ID NO: 739 - RNA, 20 nt, Artificial Sequence
  Description of Artificial Sequence: Synthetic oligonucleotide
cccaccacuccaucaucaug

SEQ ID NO: 740 - RNA, 20 nt, Artificial Sequence
  Description of Artificial Sequence: Synthetic oligonucleotide
gauacugaacuggccuuccc

SEQ ID NO: 741 - RNA, 20 nt, Artificial Sequence
  Description of Artificial Sequence: Synthetic oligonucleotide
uaggauacugaacuggccuu

SEQ ID NO: 742 - RNA, 20 nt, Artificial Sequence
  Description of Artificial Sequence: Synthetic oligonucleotide
auaggauacugaacuggccu

SEQ ID NO: 743 - RNA, 20 nt, Artificial Sequence
  Description of Artificial Sequence: Synthetic oligonucleotide
aauaggauacugaacuggcc

SEQ ID NO: 744 - RNA, 20 nt, Artificial Sequence
  Description of Artificial Sequence: Synthetic oligonucleotide
aaauaggauacugaacuggc

SEQ ID NO: 745 - RNA, 20 nt, Artificial Sequence
  Description of Artificial Sequence: Synthetic oligonucleotide
ggagaaagucacuugaggcu

SEQ ID NO: 746 - RNA, 20 nt, Artificial Sequence
  Description of Artificial Sequence: Synthetic oligonucleotide
uggagaaagucacuugaggc

SEQ ID NO: 747 - RNA, 20 nt, Artificial Sequence
  Description of Artificial Sequence: Synthetic oligonucleotide
aauggagaaagucacuugag

SEQ ID NO: 748 - RNA, 20 nt, Artificial Sequence
  Description of Artificial Sequence: Synthetic oligonucleotide
agcaauggagaaagucacuu

SEQ ID NO: 749 - RNA, 20 nt, Artificial Sequence
  Description of Artificial Sequence: Synthetic oligonucleotide
uagcgugaagcaauggagaa

SEQ ID NO: 750 - RNA, 20 nt, Artificial Sequence
  Description of Artificial Sequence: Synthetic oligonucleotide
auagcgugaagcaauggaga

SEQ ID NO: 751 - RNA, 20 nt, Artificial Sequence
  Description of Artificial Sequence: Synthetic oligonucleotide
cauagcgugaagcaauggag

SEQ ID NO: 752 - RNA, 20 nt, Artificial Sequence
  Description of Artificial Sequence: Synthetic oligonucleotide
gcauagcgugaagcaaugga

SEQ ID NO: 753 - RNA, 20 nt, Artificial Sequence
  Description of Artificial Sequence: Synthetic oligonucleotide
ggcauagcgugaagcaaugg

SEQ ID NO: 754 - RNA, 20 nt, Artificial Sequence
  Description of Artificial Sequence: Synthetic oligonucleotide
uggcauagcgugaagcaaug

SEQ ID NO: 755 - RNA, 20 nt, Artificial Sequence
  Description of Artificial Sequence: Synthetic oligonucleotide
guggcauagcgugaagcaau

SEQ ID NO: 756 - RNA, 20 nt, Artificial Sequence
  Description of Artificial Sequence: Synthetic oligonucleotide
aguggcauagcgugaagcaa

SEQ ID NO: 757 - RNA, 20 nt, Artificial Sequence
  Description of Artificial Sequence: Synthetic oligonucleotide
uaguggcauagcgugaagca

SEQ ID NO: 758 - RNA, 20 nt, Artificial Sequence
  Description of Artificial Sequence: Synthetic oligonucleotide
auaguggcauagcgugaagc

SEQ ID NO: 759 - RNA, 20 nt, Artificial Sequence
  Description of Artificial Sequence: Synthetic oligonucleotide
aauaguggcauagcgugaag

SEQ ID NO: 760 - RNA, 20 nt, Artificial Sequence
  Description of Artificial Sequence: Synthetic oligonucleotide
aaauaguggcauagcgugaa

SEQ ID NO: 761 - RNA, 20 nt, Artificial Sequence
  Description of Artificial Sequence: Synthetic oligonucleotide
aaaauaguggcauagcguga

SEQ ID NO: 762 - RNA, 20 nt, Artificial Sequence
  Description of Artificial Sequence: Synthetic oligonucleotide
gcaaaauaguggcauagcgu

SEQ ID NO: 763 - RNA, 20 nt, Artificial Sequence
  Description of Artificial Sequence: Synthetic oligonucleotide
agcaaaauaguggcauagcg

SEQ ID NO: 764 - RNA, 20 nt, Artificial Sequence
  Description of Artificial Sequence: Synthetic oligonucleotide
aagcaaaauaguggcauagc

SEQ ID NO: 765 - RNA, 20 nt, Artificial Sequence
  Description of Artificial Sequence: Synthetic oligonucleotide
aacugguugggcaaacuaua

SEQ ID NO: 766 - RNA, 20 nt, Artificial Sequence
  Description of Artificial Sequence: Synthetic oligonucleotide
aaacugguugggcaaacuau

SEQ ID NO: 767 - RNA, 20 nt, Artificial Sequence
  Description of Artificial Sequence: Synthetic oligonucleotide
aaaacugguugggcaaacua

SEQ ID NO: 768 - RNA, 20 nt, Artificial Sequence
  Description of Artificial Sequence: Synthetic oligonucleotide
uaaaacugguugggcaaacu

SEQ ID NO: 769 - RNA, 20 nt, Artificial Sequence
  Description of Artificial Sequence: Synthetic oligonucleotide
guaaaacugguugggcaaac

SEQ ID NO: 770 - RNA, 20 nt, Artificial Sequence
  Description of Artificial Sequence: Synthetic oligonucleotide
cguaaaacugguugggcaaa

SEQ ID NO: 771 - RNA, 20 nt, Artificial Sequence
  Description of Artificial Sequence: Synthetic oligonucleotide
gacguaaaacugguugggca

SEQ ID NO: 772 - RNA, 20 nt, Artificial Sequence
  Description of Artificial Sequence: Synthetic oligonucleotide
ggacguaaaacugguugggc

SEQ ID NO: 773 - RNA, 20 nt, Artificial Sequence
  Description of Artificial Sequence: Synthetic oligonucleotide
uggacguaaaacugguuggg

SEQ ID NO: 774 - RNA, 20 nt, Artificial Sequence
  Description of Artificial Sequence: Synthetic oligonucleotide
uuggacguaaaacugguugg

SEQ ID NO: 775 - RNA, 20 nt, Artificial Sequence
  Description of Artificial Sequence: Synthetic oligonucleotide
cuuggacguaaaacugguug

SEQ ID NO: 776 - RNA, 20 nt, Artificial Sequence
  Description of Artificial Sequence: Synthetic oligonucleotide
ccuuggacguaaaacugguu

SEQ ID NO: 777 - RNA, 20 nt, Artificial Sequence
  Description of Artificial Sequence: Synthetic oligonucleotide
uccuuggacguaaaacuggu

SEQ ID NO: 778 - RNA, 20 nt, Artificial Sequence
  Description of Artificial Sequence: Synthetic oligonucleotide
uuccuuggacguaaaacugg

SEQ ID NO: 779 - RNA, 20 nt, Artificial Sequence
  Description of Artificial Sequence: Synthetic oligonucleotide
uuuccuuggacguaaaacug

SEQ ID NO: 780 - RNA, 20 nt, Artificial Sequence
  Description of Artificial Sequence: Synthetic oligonucleotide
ggcuaauuuuccuuggacgu

SEQ ID NO: 781 - RNA, 20 nt, Artificial Sequence
  Description of Artificial Sequence: Synthetic oligonucleotide
uggcuaauuuuccuuggacg

SEQ ID NO: 782 - RNA, 20 nt, Artificial Sequence
  Description of Artificial Sequence: Synthetic oligonucleotide
gcauuggcuaauuuuccuug

SEQ ID NO: 783 - RNA, 20 nt, Artificial Sequence
  Description of Artificial Sequence: Synthetic oligonucleotide
uuccugauccuugccuuuca

SEQ ID NO: 784 - RNA, 20 nt, Artificial Sequence
  Description of Artificial Sequence: Synthetic oligonucleotide
ucugguuuccugauccuugc

SEQ ID NO: 785 - RNA, 20 nt, Artificial Sequence
  Description of Artificial Sequence: Synthetic oligonucleotide
ucucugguuuccugauccuu

SEQ ID NO: 786 - RNA, 20 nt, Artificial Sequence
  Description of Artificial Sequence: Synthetic oligonucleotide
gucucugguuuccugauccu

SEQ ID NO: 787 - RNA, 20 nt, Artificial Sequence
  Description of Artificial Sequence: Synthetic oligonucleotide
agucucugguuuccugaucc

SEQ ID NO: 788 - RNA, 20 nt, Artificial Sequence
  Description of Artificial Sequence: Synthetic oligonucleotide
aagucucugguuuccugauc

SEQ ID NO: 789 - RNA, 20 nt, Artificial Sequence
  Description of Artificial Sequence: Synthetic oligonucleotide
ccugacaccuaguuucuaau

SEQ ID NO: 790 - RNA, 20 nt, Artificial Sequence
  Description of Artificial Sequence: Synthetic oligonucleotide
aacccugacaccuaguuucu

SEQ ID NO: 791 - RNA, 20 nt, Artificial Sequence
  Description of Artificial Sequence: Synthetic oligonucleotide
auaaacccugacaccuaguu

SEQ ID NO: 792 - RNA, 20 nt, Artificial Sequence
  Description of Artificial Sequence: Synthetic oligonucleotide
gauaaacccugacaccuagu

SEQ ID NO: 793 - RNA, 20 nt, Artificial Sequence
  Description of Artificial Sequence: Synthetic oligonucleotide
ugauaaacccugacaccuag

SEQ ID NO: 794 - RNA, 20 nt, Artificial Sequence
  Description of Artificial Sequence: Synthetic oligonucleotide
cuugauaaacccugacaccu

SEQ ID NO: 795 - RNA, 20 nt, Artificial Sequence
  Description of Artificial Sequence: Synthetic oligonucleotide
ucuugauaaacccugacacc

SEQ ID NO: 796 - RNA, 20 nt, Artificial Sequence
  Description of Artificial Sequence: Synthetic oligonucleotide
uucuugauaaacccugacac

SEQ ID NO: 797 - RNA, 20 nt, Artificial Sequence
  Description of Artificial Sequence: Synthetic oligonucleotide
cuucuugauaaacccugaca

SEQ ID NO: 798 - RNA, 20 nt, Artificial Sequence
  Description of Artificial Sequence: Synthetic oligonucleotide
ccuucuugauaaacccugac

SEQ ID NO: 799 - RNA, 20 nt, Artificial Sequence
  Description of Artificial Sequence: Synthetic oligonucleotide
gccuucuugauaaacccuga

SEQ ID NO: 800 - RNA, 20 nt, Artificial Sequence
  Description of Artificial Sequence: Synthetic oligonucleotide
ggccuucuugauaaacccug

SEQ ID NO: 801 - RNA, 20 nt, Artificial Sequence
  Description of Artificial Sequence: Synthetic oligonucleotide
uggccuucuugauaaacccu

SEQ ID NO: 802 - RNA, 20 nt, Artificial Sequence
  Description of Artificial Sequence: Synthetic oligonucleotide
uuccuggccuucuugauaaa

SEQ ID NO: 803 - RNA, 20 nt, Artificial Sequence
  Description of Artificial Sequence: Synthetic oligonucleotide
cagagaccauucauuuggaa

SEQ ID NO: 804 - RNA, 20 nt, Artificial Sequence
  Description of Artificial Sequence: Synthetic oligonucleotide
ccagagaccauucauuugga

SEQ ID NO: 805 - RNA, 20 nt, Artificial Sequence
  Description of Artificial Sequence: Synthetic oligonucleotide
accagagaccauucauuugg

SEQ ID NO: 806 - RNA, 20 nt, Artificial Sequence
  Description of Artificial Sequence: Synthetic oligonucleotide
ugaccagagaccauucauuu

SEQ ID NO: 807 - RNA, 20 nt, Artificial Sequence
  Description of Artificial Sequence: Synthetic oligonucleotide
uugaccagagaccauucauu

SEQ ID NO: 808 - RNA, 20 nt, Artificial Sequence
  Description of Artificial Sequence: Synthetic oligonucleotide
uuugaccagagaccauucau

SEQ ID NO: 809 - RNA, 20 nt, Artificial Sequence
  Description of Artificial Sequence: Synthetic oligonucleotide
auuugaccagagaccauuca

SEQ ID NO: 810 - RNA, 20 nt, Artificial Sequence
  Description of Artificial Sequence: Synthetic oligonucleotide
cauuugaccagagaccauuc

SEQ ID NO: 811 - RNA, 20 nt, Artificial Sequence
  Description of Artificial Sequence: Synthetic oligonucleotide
auucauuugaccagagacca

SEQ ID NO: 812 - RNA, 20 nt, Artificial Sequence
  Description of Artificial Sequence: Synthetic oligonucleotide
uuguaucucugugagggcag

SEQ ID NO: 813 - RNA, 20 nt, Artificial Sequence
  Description of Artificial Sequence: Synthetic oligonucleotide
guaaggcuuaaaccaaaugg

SEQ ID NO: 814 - RNA, 20 nt, Artificial Sequence
  Description of Artificial Sequence: Synthetic oligonucleotide
cagauucgacuucauuugga

SEQ ID NO: 815 - RNA, 20 nt, Artificial Sequence
  Description of Artificial Sequence: Synthetic oligonucleotide
ggcagauucgacuucauuug

SEQ ID NO: 816 - RNA, 20 nt, Artificial Sequence
  Description of Artificial Sequence: Synthetic oligonucleotide
gggcagauucgacuucauuu

SEQ ID NO: 817 - RNA, 20 nt, Artificial Sequence
  Description of Artificial Sequence: Synthetic oligonucleotide
agggcagauucgacuucauu

SEQ ID NO: 818 - RNA, 20 nt, Artificial Sequence
  Description of Artificial Sequence: Synthetic oligonucleotide
gagggcagauucgacuucau

SEQ ID NO: 819 - RNA, 20 nt, Artificial Sequence
  Description of Artificial Sequence: Synthetic oligonucleotide
ugagggcagauucgacuuca

SEQ ID NO: 820 - RNA, 20 nt, Artificial Sequence
  Description of Artificial Sequence: Synthetic oligonucleotide
gugagggcagauucgacuuc

SEQ ID NO: 821 - RNA, 20 nt, Artificial Sequence
  Description of Artificial Sequence: Synthetic oligonucleotide
ugugagggcagauucgacuu

SEQ ID NO: 822 - RNA, 20 nt, Artificial Sequence
  Description of Artificial Sequence: Synthetic oligonucleotide
cugugagggcagauucgacu

SEQ ID NO: 823 - RNA, 20 nt, Artificial Sequence
  Description of Artificial Sequence: Synthetic oligonucleotide
cuugugucucugugagggca

SEQ ID NO: 824 - RNA, 20 nt, Artificial Sequence
  Description of Artificial Sequence: Synthetic oligonucleotide
uucuugugucucugugaggg

SEQ ID NO: 825 - RNA, 20 nt, Artificial Sequence
  Description of Artificial Sequence: Synthetic oligonucleotide
auuucagagagcaagaagcg

SEQ ID NO: 826 - RNA, 20 nt, Artificial Sequence
  Description of Artificial Sequence: Synthetic oligonucleotide
cauuucagagagcaagaagc

SEQ ID NO: 827 - RNA, 20 nt, Artificial Sequence
  Description of Artificial Sequence: Synthetic oligonucleotide
ggcauuucagagagcaagaa

SEQ ID NO: 828 - RNA, 20 nt, Artificial Sequence
  Description of Artificial Sequence: Synthetic oligonucleotide
cauuuagcagggcauuucag

SEQ ID NO: 829 - RNA, 20 nt, Artificial Sequence
  Description of Artificial Sequence: Synthetic oligonucleotide
gcauuuagcagggcauuuca

SEQ ID NO: 830 - RNA, 20 nt, Artificial Sequence
  Description of Artificial Sequence: Synthetic oligonucleotide
agcauuuagcagggcauuuc

SEQ ID NO: 831 - RNA, 20 nt, Artificial Sequence
  Description of Artificial Sequence: Synthetic oligonucleotide
agaagcauuuagcagggcau

SEQ ID NO: 832 - RNA, 20 nt, Artificial Sequence
  Description of Artificial Sequence: Synthetic oligonucleotide
gagaagcauuuagcagggca

SEQ ID NO: 833 - RNA, 20 nt, Artificial Sequence
  Description of Artificial Sequence: Synthetic oligonucleotide
cucuugacccaacaucccaa

SEQ ID NO: 834 - RNA, 20 nt, Artificial Sequence
  Description of Artificial Sequence: Synthetic oligonucleotide
ccucuugacccaacauccca

SEQ ID NO: 835 - RNA, 20 nt, Artificial Sequence
  Description of Artificial Sequence: Synthetic oligonucleotide
uggauugacuaacacuuucc

SEQ ID NO: 836 - RNA, 20 nt, Artificial Sequence
  Description of Artificial Sequence: Synthetic oligonucleotide
guggauugacuaacacuuuc

SEQ ID NO: 837 - RNA, 20 nt, Artificial Sequence
  Description of Artificial Sequence: Synthetic oligonucleotide
cuguggcaucaaagaaaggu

SEQ ID NO: 838 - RNA, 20 nt, Artificial Sequence
  Description of Artificial Sequence: Synthetic oligonucleotide
ucugacuguggcaucaaaga

SEQ ID NO: 839 - RNA, 20 nt, Artificial Sequence
  Description of Artificial Sequence: Synthetic oligonucleotide
ucucugacuguggcaucaaa

SEQ ID NO: 840 - RNA, 20 nt, Artificial Sequence
  Description of Artificial Sequence: Synthetic oligonucleotide
ggccacccaaacuguauucu

SEQ ID NO: 841 - RNA, 20 nt, Artificial Sequence
  Description of Artificial Sequence: Synthetic oligonucleotide
accaccaagucaaaguuaga

SEQ ID NO: 842 - RNA, 20 nt, Artificial Sequence
  Description of Artificial Sequence: Synthetic oligonucleotide
caccaccaagucaaaguuag

SEQ ID NO: 843 - RNA, 20 nt, Artificial Sequence
  Description of Artificial Sequence: Synthetic oligonucleotide
guccaccaccaagucaaagu

SEQ ID NO: 844 - RNA, 20 nt, Artificial Sequence
  Description of Artificial Sequence: Synthetic oligonucleotide
gguccaccaccaagucaaag

SEQ ID NO: 845 - RNA, 20 nt, Artificial Sequence
  Description of Artificial Sequence: Synthetic oligonucleotide
aggaagguccaccaccaagu

SEQ ID NO: 846 - RNA, 20 nt, Artificial Sequence
  Description of Artificial Sequence: Synthetic oligonucleotide
aaggaagguccaccaccaag

SEQ ID NO: 847 - RNA, 20 nt, Artificial Sequence
  Description of Artificial Sequence: Synthetic oligonucleotide
caaggaagguccaccaccaa

SEQ ID NO: 848 - RNA, 20 nt, Artificial Sequence
  Description of Artificial Sequence: Synthetic oligonucleotide
ccaaggaagguccaccacca

SEQ ID NO: 849 - RNA, 20 nt, Artificial Sequence
  Description of Artificial Sequence: Synthetic oligonucleotide
accaaggaagguccaccacc

SEQ ID NO: 850 - RNA, 20 nt, Artificial Sequence
  Description of Artificial Sequence: Synthetic oligonucleotide
aaccaaggaagguccaccac

SEQ ID NO: 851 - RNA, 20 nt, Artificial Sequence
  Description of Artificial Sequence: Synthetic oligonucleotide
aaaccaaggaagguccacca

SEQ ID NO: 852 - RNA, 20 nt, Artificial Sequence
  Description of Artificial Sequence: Synthetic oligonucleotide
guugaugguacaguucuacu

SEQ ID NO: 853 - RNA, 20 nt, Artificial Sequence
  Description of Artificial Sequence: Synthetic oligonucleotide
uguugaugguacaguucuac

SEQ ID NO: 854 - RNA, 20 nt, Artificial Sequence
  Description of Artificial Sequence: Synthetic oligonucleotide
cauuguugaugguacaguuc

SEQ ID NO: 855 - RNA, 20 nt, Artificial Sequence
  Description of Artificial Sequence: Synthetic oligonucleotide
ggaaacauuguugaugguac

SEQ ID NO: 856 - RNA, 20 nt, Artificial Sequence
  Description of Artificial Sequence: Synthetic oligonucleotide
guauuggcacaguaauucuc

SEQ ID NO: 857 - RNA, 20 nt, Artificial Sequence
  Description of Artificial Sequence: Synthetic oligonucleotide
caguauuggcacaguaauuc

SEQ ID NO: 858 - RNA, 20 nt, Artificial Sequence
  Description of Artificial Sequence: Synthetic oligonucleotide
ucaaaacaguauuggcacag

SEQ ID NO: 859 - RNA, 19 nt, Artificial Sequence
  Description of Artificial Sequence: Synthetic oligonucleotide
aaagaucacagaagcugcc

SEQ ID NO: 860 - RNA, 19 nt, Artificial Sequence
  Description of Artificial Sequence: Synthetic oligonucleotide
ggcagcuucugugaucuuu

SEQ ID NO: 861 - RNA, 19 nt, Artificial Sequence
  Description of Artificial Sequence: Synthetic oligonucleotide
aagaucacagaagcugccc

SEQ ID NO: 862 - RNA, 19 nt, Artificial Sequence
  Description of Artificial Sequence: Synthetic oligonucleotide
gggcagcuucugugaucuu

SEQ ID NO: 863 - RNA, 19 nt, Artificial Sequence
  Description of Artificial Sequence: Synthetic oligonucleotide
agaucacagaagcugcccg

SEQ ID NO: 864 - RNA, 19 nt, Artificial Sequence
  Description of Artificial Sequence: Synthetic oligonucleotide
cgggcagcuucugugaucu

SEQ ID NO: 865 - RNA, 19 nt, Artificial Sequence
  Description of Artificial Sequence: Synthetic oligonucleotide
ccgggagguguuugauuaa

SEQ ID NO: 866 - RNA, 19 nt, Artificial Sequence
  Description of Artificial Sequence: Synthetic oligonucleotide
uuaaucaaacaccucccgg

SEQ ID NO: 867 - RNA, 19 nt, Artificial Sequence
  Description of Artificial Sequence: Synthetic oligonucleotide
cgggagguguuugauuaaa

SEQ ID NO: 868 - RNA, 19 nt, Artificial Sequence
  Description of Artificial Sequence: Synthetic oligonucleotide
uuuaaucaaacaccucccg

SEQ ID NO: 869 - RNA, 19 nt, Artificial Sequence
  Description of Artificial Sequence: Synthetic oligonucleotide
gggagguguuugauuaaau

SEQ ID NO: 870 - RNA, 19 nt, Artificial Sequence
  Description of Artificial Sequence: Synthetic oligonucleotide
auuuaaucaaacaccuccc

SEQ ID NO: 871 - RNA, 19 nt, Artificial Sequence
  Description of Artificial Sequence: Synthetic oligonucleotide
ggagguguuugauuaaauu

SEQ ID NO: 872 - RNA, 19 nt, Artificial Sequence
  Description of Artificial Sequence: Synthetic oligonucleotide
aauuuaaucaaacaccucc

SEQ ID NO: 873 - RNA, 19 nt, Artificial Sequence
  Description of Artificial Sequence: Synthetic oligonucleotide
gagguguuugauuaaauuc

SEQ ID NO: 874 - RNA, 19 nt, Artificial Sequence
  Description of Artificial Sequence: Synthetic oligonucleotide
gaauuuaaucaaacaccuc

SEQ ID NO: 875 - RNA, 19 nt, Artificial Sequence
  Description of Artificial Sequence: Synthetic oligonucleotide
augugacauaacuggagcc

SEQ ID NO: 876 - RNA, 19 nt, Artificial Sequence
  Description of Artificial Sequence: Synthetic oligonucleotide
ggcuccaguuaugucacau

SEQ ID NO: 877 - RNA, 19 nt, Artificial Sequence
  Description of Artificial Sequence: Synthetic oligonucleotide
ugugacauaacuggagcca

SEQ ID NO: 878 - RNA, 19 nt, Artificial Sequence
  Description of Artificial Sequence: Synthetic oligonucleotide
uggcuccaguuaugucaca

SEQ ID NO: 879 - RNA, 19 nt, Artificial Sequence
  Description of Artificial Sequence: Synthetic oligonucleotide
uggagccagugcagugcca

SEQ ID NO: 880 - RNA, 19 nt, Artificial Sequence
  Description of Artificial Sequence: Synthetic oligonucleotide
uggcacugcacuggcucca

SEQ ID NO: 881 - RNA, 19 nt, Artificial Sequence
  Description of Artificial Sequence: Synthetic oligonucleotide
gccagugcagugccaugaa

SEQ ID NO: 882 - RNA, 19 nt, Artificial Sequence
  Description of Artificial Sequence: Synthetic oligonucleotide
uucauggcacugcacuggc

SEQ ID NO: 883 - RNA, 19 nt, Artificial Sequence
  Description of Artificial Sequence: Synthetic oligonucleotide
ccagugcagugccaugaag

SEQ ID NO: 884 - RNA, 19 nt, Artificial Sequence
  Description of Artificial Sequence: Synthetic oligonucleotide
cuucauggcacugcacugg

SEQ ID NO: 885 - RNA, 19 nt, Artificial Sequence
  Description of Artificial Sequence: Synthetic oligonucleotide
cagugcagugccaugaaga

SEQ ID NO: 886 - RNA, 19 nt, Artificial Sequence
  Description of Artificial Sequence: Synthetic oligonucleotide
ucuucauggcacugcacug

SEQ ID NO: 887 - RNA, 19 nt, Artificial Sequence
  Description of Artificial Sequence: Synthetic oligonucleotide
agugcagugccaugaagaa

SEQ ID NO: 888 - RNA, 19 nt, Artificial Sequence
  Description of Artificial Sequence: Synthetic oligonucleotide
uucuucauggcacugcacu

SEQ ID NO: 889 - RNA, 19 nt, Artificial Sequence
  Description of Artificial Sequence: Synthetic oligonucleotide
agauuagccuggauauuaa

SEQ ID NO: 890 - RNA, 19 nt, Artificial Sequence
  Description of Artificial Sequence: Synthetic oligonucleotide
uuaauauccaggcuaaucu

SEQ ID NO: 891 - RNA, 19 nt, Artificial Sequence
  Description of Artificial Sequence: Synthetic oligonucleotide
gauuagccuggauauuaac

SEQ ID NO: 892 - RNA, 19 nt, Artificial Sequence
  Description of Artificial Sequence: Synthetic oligonucleotide
guuaauauccaggcuaauc

SEQ ID NO: 893 - RNA, 19 nt, Artificial Sequence
  Description of Artificial Sequence: Synthetic oligonucleotide
auuagccuggauauuaacu

SEQ ID NO: 894 - RNA, 19 nt, Artificial Sequence
  Description of Artificial Sequence: Synthetic oligonucleotide
aguuaauauccaggcuaau

SEQ ID NO: 895 - RNA, 19 nt, Artificial Sequence
  Description of Artificial Sequence: Synthetic oligonucleotide
uuagccuggauauuaacuu

SEQ ID NO: 896 - RNA, 19 nt, Artificial Sequence
  Description of Artificial Sequence: Synthetic oligonucleotide
aaguuaauauccaggcuaa

SEQ ID NO: 897 - RNA, 19 nt, Artificial Sequence
  Description of Artificial Sequence: Synthetic oligonucleotide
uagccuggauauuaacuug

SEQ ID NO: 898 - RNA, 19 nt, Artificial Sequence
  Description of Artificial Sequence: Synthetic oligonucleotide
caaguuaauauccaggcua

SEQ ID NO: 899 - RNA, 19 nt, Artificial Sequence
  Description of Artificial Sequence: Synthetic oligonucleotide
gccuggauauuaacuuguc

SEQ ID NO: 900 - RNA, 19 nt, Artificial Sequence
  Description of Artificial Sequence: Synthetic oligonucleotide
gacaaguuaauauccaggc

SEQ ID NO: 901 - RNA, 19 nt, Artificial Sequence
  Description of Artificial Sequence: Synthetic oligonucleotide
ccuggauauuaacuugucu

SEQ ID NO: 902 - RNA, 19 nt, Artificial Sequence
  Description of Artificial Sequence: Synthetic oligonucleotide
agacaaguuaauauccagg

SEQ ID NO: 903 - RNA, 19 nt, Artificial Sequence
  Description of Artificial Sequence: Synthetic oligonucleotide
cuggauauuaacuugucuu

SEQ ID NO: 904 - RNA, 19 nt, Artificial Sequence
  Description of Artificial Sequence: Synthetic oligonucleotide
aagacaaguuaauauccag

SEQ ID NO: 905 - RNA, 19 nt, Artificial Sequence
  Description of Artificial Sequence: Synthetic oligonucleotide
uggauauuaacuugucuuc

SEQ ID NO: 906 - RNA, 19 nt, Artificial Sequence
  Description of Artificial Sequence: Synthetic oligonucleotide
gaagacaaguuaauaucca

SEQ ID NO: 907 - RNA, 19 nt, Artificial Sequence
  Description of Artificial Sequence: Synthetic oligonucleotide
ggauauuaacuugucuucu

SEQ ID NO: 908 - RNA, 19 nt, Artificial Sequence
  Description of Artificial Sequence: Synthetic oligonucleotide
agaagacaaguuaauaucc

SEQ ID NO: 909 - RNA, 19 nt, Artificial Sequence
  Description of Artificial Sequence: Synthetic oligonucleotide
auuaacuugucuucuagag

SEQ ID NO: 910 - RNA, 19 nt, Artificial Sequence
  Description of Artificial Sequence: Synthetic oligonucleotide
cucuagaagacaaguuaau

SEQ ID NO: 911 - RNA, 19 nt, Artificial Sequence
  Description of Artificial Sequence: Synthetic oligonucleotide
agaauagauuucauguucc

SEQ ID NO: 912 - RNA, 19 nt, Artificial Sequence
  Description of Artificial Sequence: Synthetic oligonucleotide
ggaacaugaaaucuauucu

SEQ ID NO: 913 - RNA, 19 nt, Artificial Sequence
  Description of Artificial Sequence: Synthetic oligonucleotide
gaauagauuucauguucca

SEQ ID NO: 914 - RNA, 19 nt, Artificial Sequence
  Description of Artificial Sequence: Synthetic oligonucleotide
uggaacaugaaaucuauuc

SEQ ID NO: 915 - RNA, 19 nt, Artificial Sequence
  Description of Artificial Sequence: Synthetic oligonucleotide
uagauuucauguuccauuc

SEQ ID NO: 916 - RNA, 19 nt, Artificial Sequence
  Description of Artificial Sequence: Synthetic oligonucleotide
gaauggaacaugaaaucua

SEQ ID NO: 917 - RNA, 19 nt, Artificial Sequence
  Description of Artificial Sequence: Synthetic oligonucleotide
gauuucauguuccauucuu

SEQ ID NO: 918 - RNA, 19 nt, Artificial Sequence
  Description of Artificial Sequence: Synthetic oligonucleotide
aagaauggaacaugaaauc

SEQ ID NO: 919 - RNA, 19 nt, Artificial Sequence
  Description of Artificial Sequence: Synthetic oligonucleotide
auuucauguuccauucuuc

SEQ ID NO: 920 - RNA, 19 nt, Artificial Sequence
  Description of Artificial Sequence: Synthetic oligonucleotide
gaagaauggaacaugaaau

SEQ ID NO: 921 - RNA, 19 nt, Artificial Sequence
  Description of Artificial Sequence: Synthetic oligonucleotide
uuucauguuccauucuucu

SEQ ID NO: 922 - RNA, 19 nt, Artificial Sequence
  Description of Artificial Sequence: Synthetic oligonucleotide
agaagaauggaacaugaaa

SEQ ID NO: 923 - RNA, 19 nt, Artificial Sequence
  Description of Artificial Sequence: Synthetic oligonucleotide
uucauguuccauucuucug

SEQ ID NO: 924 - RNA, 19 nt, Artificial Sequence
  Description of Artificial Sequence: Synthetic oligonucleotide
cagaagaauggaacaugaa

SEQ ID NO: 925 - RNA, 19 nt, Artificial Sequence
  Description of Artificial Sequence: Synthetic oligonucleotide
ucauguuccauucuucugc

SEQ ID NO: 926 - RNA, 19 nt, Artificial Sequence
  Description of Artificial Sequence: Synthetic oligonucleotide
gcagaagaauggaacauga

SEQ ID NO: 927 - RNA, 19 nt, Artificial Sequence
  Description of Artificial Sequence: Synthetic oligonucleotide
cauguuccauucuucugca

SEQ ID NO: 928 - RNA, 19 nt, Artificial Sequence
  Description of Artificial Sequence: Synthetic oligonucleotide
ugcagaagaauggaacaug

SEQ ID NO: 929 - RNA, 19 nt, Artificial Sequence
  Description of Artificial Sequence: Synthetic oligonucleotide
ucuucugcaaugguuaauu

SEQ ID NO: 930 - RNA, 19 nt, Artificial Sequence
  Description of Artificial Sequence: Synthetic oligonucleotide
aauuaaccauugcagaaga

SEQ ID NO: 931 - RNA, 19 nt, Artificial Sequence
  Description of Artificial Sequence: Synthetic oligonucleotide
uucugcaaugguuaauuca

SEQ ID NO: 932 - RNA, 19 nt, Artificial Sequence
  Description of Artificial Sequence: Synthetic oligonucleotide
ugaauuaaccauugcagaa

SEQ ID NO: 933 - RNA, 19 nt, Artificial Sequence
  Description of Artificial Sequence: Synthetic oligonucleotide
cauucacagaggauuuuac

SEQ ID NO: 934 - RNA, 19 nt, Artificial Sequence
  Description of Artificial Sequence: Synthetic oligonucleotide
guaaaauccucugugaaug

SEQ ID NO: 935 - RNA, 19 nt, Artificial Sequence
  Description of Artificial Sequence: Synthetic oligonucleotide
auucacagaggauuuuacu

SEQ ID NO: 936 - RNA, 19 nt, Artificial Sequence
  Description of Artificial Sequence: Synthetic oligonucleotide
aguaaaauccucugugaau

SEQ ID NO: 937 - RNA, 19 nt, Artificial Sequence
  Description of Artificial Sequence: Synthetic oligonucleotide
acagaggauuuuacugcuu

SEQ ID NO: 938 - RNA, 19 nt, Artificial Sequence
  Description of Artificial Sequence: Synthetic oligonucleotide
aagcaguaaaauccucugu

SEQ ID NO: 939 - RNA, 19 nt, Artificial Sequence
  Description of Artificial Sequence: Synthetic oligonucleotide
cagaggauuuuacugcuua

SEQ ID NO: 940 - RNA, 19 nt, Artificial Sequence
  Description of Artificial Sequence: Synthetic oligonucleotide
uaagcaguaaaauccucug

SEQ ID NO: 941 - RNA, 19 nt, Artificial Sequence
  Description of Artificial Sequence: Synthetic oligonucleotide
agaggauuuuacugcuuaa

SEQ ID NO: 942 - RNA, 19 nt, Artificial Sequence
  Description of Artificial Sequence: Synthetic oligonucleotide
uuaagcaguaaaauccucu

SEQ ID NO: 943 - RNA, 19 nt, Artificial Sequence
  Description of Artificial Sequence: Synthetic oligonucleotide
gaggauuuuacugcuuaac

SEQ ID NO: 944 - RNA, 19 nt, Artificial Sequence
  Description of Artificial Sequence: Synthetic oligonucleotide
guuaagcaguaaaauccuc

SEQ ID NO: 945 - RNA, 19 nt, Artificial Sequence
  Description of Artificial Sequence: Synthetic oligonucleotide
auaugcauuuguucucagu

SEQ ID NO: 946 - RNA, 19 nt, Artificial Sequence
  Description of Artificial Sequence: Synthetic oligonucleotide
acugagaacaaaugcauau

SEQ ID NO: 947 - RNA, 19 nt, Artificial Sequence
  Description of Artificial Sequence: Synthetic oligonucleotide
augcauuuguucucaguuc

SEQ ID NO: 948 - RNA, 19 nt, Artificial Sequence
  Description of Artificial Sequence: Synthetic oligonucleotide
gaacugagaacaaaugcau

SEQ ID NO: 949 - RNA, 19 nt, Artificial Sequence
  Description of Artificial Sequence: Synthetic oligonucleotide
uuuguucucaguucucagu

SEQ ID NO: 950 - RNA, 19 nt, Artificial Sequence
  Description of Artificial Sequence: Synthetic oligonucleotide
acugagaacugagaacaaa

SEQ ID NO: 951 - RNA, 19 nt, Artificial Sequence
  Description of Artificial Sequence: Synthetic oligonucleotide
uuguucucaguucucagug

SEQ ID NO: 952 - RNA, 19 nt, Artificial Sequence
  Description of Artificial Sequence: Synthetic oligonucleotide
cacugagaacugagaacaa

SEQ ID NO: 953 - RNA, 19 nt, Artificial Sequence
  Description of Artificial Sequence: Synthetic oligonucleotide
guucucaguucucagugcc

SEQ ID NO: 954 - RNA, 19 nt, Artificial Sequence
  Description of Artificial Sequence: Synthetic oligonucleotide
ggcacugagaacugagaac

SEQ ID NO: 955 - RNA, 19 nt, Artificial Sequence
  Description of Artificial Sequence: Synthetic oligonucleotide
uucucaguucucagugcca

SEQ ID NO: 956 - RNA, 19 nt, Artificial Sequence
  Description of Artificial Sequence: Synthetic oligonucleotide
uggcacugagaacugagaa

SEQ ID NO: 957 - RNA, 19 nt, Artificial Sequence
  Description of Artificial Sequence: Synthetic oligonucleotide
caguucucagugccaucua

SEQ ID NO: 958 - RNA, 19 nt, Artificial Sequence
  Description of Artificial Sequence: Synthetic oligonucleotide
uagauggcacugagaacug

SEQ ID NO: 959 - RNA, 19 nt, Artificial Sequence
  Description of Artificial Sequence: Synthetic oligonucleotide
aguucucagugccaucuag

SEQ ID NO: 960 - RNA, 19 nt, Artificial Sequence
  Description of Artificial Sequence: Synthetic oligonucleotide
cuagauggcacugagaacu

SEQ ID NO: 961 - RNA, 19 nt, Artificial Sequence
  Description of Artificial Sequence: Synthetic oligonucleotide
ucagugccaucuaguuauc

SEQ ID NO: 962 - RNA, 19 nt, Artificial Sequence
  Description of Artificial Sequence: Synthetic oligonucleotide
gauaacuagauggcacuga

SEQ ID NO: 963 - RNA, 19 nt, Artificial Sequence
  Description of Artificial Sequence: Synthetic oligonucleotide
cagugccaucuaguuauca

SEQ ID NO: 964 - RNA, 19 nt, Artificial Sequence
  Description of Artificial Sequence: Synthetic oligonucleotide
ugauaacuagauggcacug

SEQ ID NO: 965 - RNA, 19 nt, Artificial Sequence
  Description of Artificial Sequence: Synthetic oligonucleotide
agugccaucuaguuaucac

SEQ ID NO: 966 - RNA, 19 nt, Artificial Sequence
  Description of Artificial Sequence: Synthetic oligonucleotide
gugauaacuagauggcacu

SEQ ID NO: 967 - RNA, 19 nt, Artificial Sequence
  Description of Artificial Sequence: Synthetic oligonucleotide
gugccaucuaguuaucacu

SEQ ID NO: 968 - RNA, 19 nt, Artificial Sequence
  Description of Artificial Sequence: Synthetic oligonucleotide
agugauaacuagauggcac

SEQ ID NO: 969 - RNA, 19 nt, Artificial Sequence
  Description of Artificial Sequence: Synthetic oligonucleotide
ugccaucuaguuaucacuu

SEQ ID NO: 970 - RNA, 19 nt, Artificial Sequence
  Description of Artificial Sequence: Synthetic oligonucleotide
aagugauaacuagauggca

SEQ ID NO: 971 - RNA, 19 nt, Artificial Sequence
  Description of Artificial Sequence: Synthetic oligonucleotide
gccaucuaguuaucacuuc

SEQ ID NO: 972 - RNA, 19 nt, Artificial Sequence
  Description of Artificial Sequence: Synthetic oligonucleotide
gaagugauaacuagauggc

SEQ ID NO: 973 - RNA, 19 nt, Artificial Sequence
  Description of Artificial Sequence: Synthetic oligonucleotide
ccaucuaguuaucacuuca

SEQ ID NO: 974 - RNA, 19 nt, Artificial Sequence
  Description of Artificial Sequence: Synthetic oligonucleotide
ugaagugauaacuagaugg

SEQ ID NO: 975 - RNA, 19 nt, Artificial Sequence
  Description of Artificial Sequence: Synthetic oligonucleotide
caucuaguuaucacuucac

SEQ ID NO: 976 - RNA, 19 nt, Artificial Sequence
  Description of Artificial Sequence: Synthetic oligonucleotide
gugaagugauaacuagaug

SEQ ID NO: 977 - RNA, 19 nt, Artificial Sequence
  Description of Artificial Sequence: Synthetic oligonucleotide
aucuaguuaucacuucacu

SEQ ID NO: 978 - RNA, 19 nt, Artificial Sequence
  Description of Artificial Sequence: Synthetic oligonucleotide
agugaagugauaacuagau

SEQ ID NO: 979 - RNA, 19 nt, Artificial Sequence
  Description of Artificial Sequence: Synthetic oligonucleotide
ucuaguuaucacuucacug

SEQ ID NO: 980 - RNA, 19 nt, Artificial Sequence
  Description of Artificial Sequence: Synthetic oligonucleotide
cagugaagugauaacuaga

SEQ ID NO: 981 - RNA, 19 nt, Artificial Sequence
  Description of Artificial Sequence: Synthetic oligonucleotide
cuaguuaucacuucacuga

SEQ ID NO: 982 - RNA, 19 nt, Artificial Sequence
  Description of Artificial Sequence: Synthetic oligonucleotide
ucagugaagugauaacuag

SEQ ID NO: 983 - RNA, 19 nt, Artificial Sequence
  Description of Artificial Sequence: Synthetic oligonucleotide
uaguuaucacuucacugag

SEQ ID NO: 984 - RNA, 19 nt, Artificial Sequence
  Description of Artificial Sequence: Synthetic oligonucleotide
cucagugaagugauaacua

SEQ ID NO: 985 - RNA, 19 nt, Artificial Sequence
  Description of Artificial Sequence: Synthetic oligonucleotide
aguuaucacuucacugagg

SEQ ID NO: 986 - RNA, 19 nt, Artificial Sequence
  Description of Artificial Sequence: Synthetic oligonucleotide
ccucagugaagugauaacu

SEQ ID NO: 987 - RNA, 19 nt, Artificial Sequence
  Description of Artificial Sequence: Synthetic oligonucleotide
guuaucacuucacugagga

SEQ ID NO: 988 - RNA, 19 nt, Artificial Sequence
  Description of Artificial Sequence: Synthetic oligonucleotide
uccucagugaagugauaac

SEQ ID NO: 989 - RNA, 19 nt, Artificial Sequence
  Description of Artificial Sequence: Synthetic oligonucleotide
uuaucacuucacugaggau

SEQ ID NO: 990 - RNA, 19 nt, Artificial Sequence
  Description of Artificial Sequence: Synthetic oligonucleotide
auccucagugaagugauaa

SEQ ID NO: 991 - RNA, 19 nt, Artificial Sequence
  Description of Artificial Sequence: Synthetic oligonucleotide
uaucacuucacugaggauc

SEQ ID NO: 992 - RNA, 19 nt, Artificial Sequence
  Description of Artificial Sequence: Synthetic oligonucleotide
gauccucagugaagugaua

SEQ ID NO: 993 - RNA, 19 nt, Artificial Sequence
  Description of Artificial Sequence: Synthetic oligonucleotide
aucacuucacugaggaucc

SEQ ID NO: 994 - RNA, 19 nt, Artificial Sequence
  Description of Artificial Sequence: Synthetic oligonucleotide
ggauccucagugaagugau

SEQ ID NO: 995 - RNA, 19 nt, Artificial Sequence
  Description of Artificial Sequence: Synthetic oligonucleotide
ucacuucacugaggauccu

SEQ ID NO: 996 - RNA, 19 nt, Artificial Sequence
  Description of Artificial Sequence: Synthetic oligonucleotide
aggauccucagugaaguga

SEQ ID NO: 997 - RNA, 19 nt, Artificial Sequence
  Description of Artificial Sequence: Synthetic oligonucleotide
gcuuucccaguagccacua

SEQ ID NO: 998 - RNA, 19 nt, Artificial Sequence
  Description of Artificial Sequence: Synthetic oligonucleotide
uaguggcuacugggaaagc

SEQ ID NO: 999 - RNA, 19 nt, Artificial Sequence
  Description of Artificial Sequence: Synthetic oligonucleotide
cuuucccaguagccacuaa

SEQ ID NO: 1000 - RNA, 19 nt, Artificial Sequence
  Description of Artificial Sequence: Synthetic oligonucleotide
uuaguggcuacugggaaag

SEQ ID NO: 1001 - RNA, 19 nt, Artificial Sequence
  Description of Artificial Sequence: Synthetic oligonucleotide
uuucccaguagccacuaau

SEQ ID NO: 1002 - RNA, 19 nt, Artificial Sequence
  Description of Artificial Sequence: Synthetic oligonucleotide
auuaguggcuacugggaaa

SEQ ID NO: 1003 - RNA, 19 nt, Artificial Sequence
  Description of Artificial Sequence: Synthetic oligonucleotide
uucccaguagccacuaaug

SEQ ID NO: 1004 - RNA, 19 nt, Artificial Sequence
  Description of Artificial Sequence: Synthetic oligonucleotide
cauuaguggcuacugggaa

SEQ ID NO: 1005 - RNA, 19 nt, Artificial Sequence
  Description of Artificial Sequence: Synthetic oligonucleotide
ucccaguagccacuaaugg

SEQ ID NO: 1006 - RNA, 19 nt, Artificial Sequence
  Description of Artificial Sequence: Synthetic oligonucleotide
ccauuaguggcuacuggga

SEQ ID NO: 1007 - RNA, 19 nt, Artificial Sequence
  Description of Artificial Sequence: Synthetic oligonucleotide
cuuggcaggagcuaaggcu

SEQ ID NO: 1008 - RNA, 19 nt, Artificial Sequence
  Description of Artificial Sequence: Synthetic oligonucleotide
agccuuagcuccugccaag

SEQ ID NO: 1009 - RNA, 19 nt, Artificial Sequence
  Description of Artificial Sequence: Synthetic oligonucleotide
ucaaaucugcagcagcaug

SEQ ID NO: 1010 - RNA, 19 nt, Artificial Sequence
  Description of Artificial Sequence: Synthetic oligonucleotide
caugcugcugcagauuuga

SEQ ID NO: 1011 - RNA, 19 nt, Artificial Sequence
  Description of Artificial Sequence: Synthetic oligonucleotide
caaaucugcagcagcauga

SEQ ID NO: 1012 - RNA, 19 nt, Artificial Sequence
  Description of Artificial Sequence: Synthetic oligonucleotide
ucaugcugcugcagauuug

SEQ ID NO: 1013 - RNA, 19 nt, Artificial Sequence
  Description of Artificial Sequence: Synthetic oligonucleotide
aaaucugcagcagcaugau

SEQ ID NO: 1014 - RNA, 19 nt, Artificial Sequence
  Description of Artificial Sequence: Synthetic oligonucleotide
aucaugcugcugcagauuu

SEQ ID NO: 1015 - RNA, 19 nt, Artificial Sequence
  Description of Artificial Sequence: Synthetic oligonucleotide
augugacauaacuggagcc

SEQ ID NO: 1016 - RNA, 19 nt, Artificial Sequence
  Description of Artificial Sequence: Synthetic oligonucleotide
ggcuccaguuaugucacau

SEQ ID NO: 1017 - RNA, 19 nt, Artificial Sequence
  Description of Artificial Sequence: Synthetic oligonucleotide
ugugacauaacuggagcca

SEQ ID NO: 1018 - RNA, 19 nt, Artificial Sequence
  Description of Artificial Sequence: Synthetic oligonucleotide
uggcuccaguuaugucaca

SEQ ID NO: 1019 - RNA, 19 nt, Artificial Sequence
  Description of Artificial Sequence: Synthetic oligonucleotide
uggagccagugcagugcca

SEQ ID NO: 1020 - RNA, 19 nt, Artificial Sequence
  Description of Artificial Sequence: Synthetic oligonucleotide
uggcacugcacuggcucca

SEQ ID NO: 1021 - RNA, 19 nt, Artificial Sequence
  Description of Artificial Sequence: Synthetic oligonucleotide
gccagugcagugccaugaa

SEQ ID NO: 1022 - RNA, 19 nt, Artificial Sequence
  Description of Artificial Sequence: Synthetic oligonucleotide
uucauggcacugcacuggc

SEQ ID NO: 1023 - RNA, 19 nt, Artificial Sequence
  Description of Artificial Sequence: Synthetic oligonucleotide
ccagugcagugccaugaag

SEQ ID NO: 1024 - RNA, 19 nt, Artificial Sequence
  Description of Artificial Sequence: Synthetic oligonucleotide
cuucauggcacugcacugg

SEQ ID NO: 1025 - RNA, 19 nt, Artificial Sequence
  Description of Artificial Sequence: Synthetic oligonucleotide
cagugcagugccaugaaga

SEQ ID NO: 1026 - RNA, 19 nt, Artificial Sequence
  Description of Artificial Sequence: Synthetic oligonucleotide
ucuucauggcacugcacug

SEQ ID NO: 1027 - RNA, 19 nt, Artificial Sequence
  Description of Artificial Sequence: Synthetic oligonucleotide
agugcagugccaugaagaa

SEQ ID NO: 1028 - RNA, 19 nt, Artificial Sequence
  Description of Artificial Sequence: Synthetic oligonucleotide
uucuucauggcacugcacu

SEQ ID NO: 1029 - RNA, 19 nt, Artificial Sequence
  Description of Artificial Sequence: Synthetic oligonucleotide
agauuagccuggauauuaa

SEQ ID NO: 1030 - RNA, 19 nt, Artificial Sequence
  Description of Artificial Sequence: Synthetic oligonucleotide
uuaauauccaggcuaaucu

SEQ ID NO: 1031 - RNA, 19 nt, Artificial Sequence
  Description of Artificial Sequence: Synthetic oligonucleotide
gauuagccuggauauuaac

SEQ ID NO: 1032 - RNA, 19 nt, Artificial Sequence
  Description of Artificial Sequence: Synthetic oligonucleotide
guuaauauccaggcuaauc

SEQ ID NO: 1033 - RNA, 19 nt, Artificial Sequence
  Description of Artificial Sequence: Synthetic oligonucleotide
auuagccuggauauuaacu

SEQ ID NO: 1034 - RNA, 19 nt, Artificial Sequence
  Description of Artificial Sequence: Synthetic oligonucleotide
aguuaauauccaggcuaau

SEQ ID NO: 1035 - RNA, 19 nt, Artificial Sequence
  Description of Artificial Sequence: Synthetic oligonucleotide
uuagccuggauauuaacuu

SEQ ID NO: 1036 - RNA, 19 nt, Artificial Sequence
  Description of Artificial Sequence: Synthetic oligonucleotide
aaguuaauauccaggcuaa

SEQ ID NO: 1037 - RNA, 19 nt, Artificial Sequence
  Description of Artificial Sequence: Synthetic oligonucleotide
uagccuggauauuaacuug

SEQ ID NO: 1038 - RNA, 19 nt, Artificial Sequence
  Description of Artificial Sequence: Synthetic oligonucleotide
caaguuaauauccaggcua

SEQ ID NO: 1039 - RNA, 19 nt, Artificial Sequence
  Description of Artificial Sequence: Synthetic oligonucleotide
gccuggauauuaacuuguc

SEQ ID NO: 1040 - RNA, 19 nt, Artificial Sequence
  Description of Artificial Sequence: Synthetic oligonucleotide
gacaaguuaauauccaggc

SEQ ID NO: 1041 - RNA, 19 nt, Artificial Sequence
  Description of Artificial Sequence: Synthetic oligonucleotide
ccuggauauuaacuugucu

SEQ ID NO: 1042 - RNA, 19 nt, Artificial Sequence
  Description of Artificial Sequence: Synthetic oligonucleotide
agacaaguuaauauccagg

SEQ ID NO: 1043 - RNA, 19 nt, Artificial Sequence
  Description of Artificial Sequence: Synthetic oligonucleotide
cuggauauuaacuugucuu

SEQ ID NO: 1044 - RNA, 19 nt, Artificial Sequence
  Description of Artificial Sequence: Synthetic oligonucleotide
aagacaaguuaauauccag

SEQ ID NO: 1045 - RNA, 19 nt, Artificial Sequence
  Description of Artificial Sequence: Synthetic oligonucleotide
uggauauuaacuugucuuc

SEQ ID NO: 1046 - RNA, 19 nt, Artificial Sequence
  Description of Artificial Sequence: Synthetic oligonucleotide
gaagacaaguuaauaucca

SEQ ID NO: 1047 - RNA, 19 nt, Artificial Sequence
  Description of Artificial Sequence: Synthetic oligonucleotide
ggauauuaacuugucuucu

SEQ ID NO: 1048 - RNA, 19 nt, Artificial Sequence
  Description of Artificial Sequence: Synthetic oligonucleotide
agaagacaaguuaauaucc

SEQ ID NO: 1049 - RNA, 19 nt, Artificial Sequence
  Description of Artificial Sequence: Synthetic oligonucleotide
auuaacuugucuucuagag

SEQ ID NO: 1050 - RNA, 19 nt, Artificial Sequence
  Description of Artificial Sequence: Synthetic oligonucleotide
cucuagaagacaaguuaau

SEQ ID NO: 1051 - RNA, 19 nt, Artificial Sequence
  Description of Artificial Sequence: Synthetic oligonucleotide
agaauagauuucauguucc

SEQ ID NO: 1052 - RNA, 19 nt, Artificial Sequence
  Description of Artificial Sequence: Synthetic oligonucleotide
ggaacaugaaaucuauucu

SEQ ID NO: 1053 - RNA, 19 nt, Artificial Sequence
  Description of Artificial Sequence: Synthetic oligonucleotide
gaauagauuucauguucca

SEQ ID NO: 1054 - RNA, 19 nt, Artificial Sequence
  Description of Artificial Sequence: Synthetic oligonucleotide
uggaacaugaaaucuauuc

SEQ ID NO: 1055 - RNA, 19 nt, Artificial Sequence
  Description of Artificial Sequence: Synthetic oligonucleotide
uagauuucauguuccauuc

SEQ ID NO: 1056 - RNA, 19 nt, Artificial Sequence
  Description of Artificial Sequence: Synthetic oligonucleotide
gaauggaacaugaaaucua

SEQ ID NO: 1057 - RNA, 19 nt, Artificial Sequence
  Description of Artificial Sequence: Synthetic oligonucleotide
gauuucauguuccauucuu

SEQ ID NO: 1058 - RNA, 19 nt, Artificial Sequence
  Description of Artificial Sequence: Synthetic oligonucleotide
aagaauggaacaugaaauc

SEQ ID NO: 1059 - RNA, 19 nt, Artificial Sequence
  Description of Artificial Sequence: Synthetic oligonucleotide
auuucauguuccauucuuc

SEQ ID NO: 1060 - RNA, 19 nt, Artificial Sequence
  Description of Artificial Sequence: Synthetic oligonucleotide
gaagaauggaacaugaaau

SEQ ID NO: 1061 - RNA, 19 nt, Artificial Sequence
  Description of Artificial Sequence: Synthetic oligonucleotide
uuucauguuccauucuucu

SEQ ID NO: 1062 - RNA, 19 nt, Artificial Sequence
  Description of Artificial Sequence: Synthetic oligonucleotide
agaagaauggaacaugaaa

SEQ ID NO: 1063 - RNA, 19 nt, Artificial Sequence
  Description of Artificial Sequence: Synthetic oligonucleotide
uucauguuccauucuucug

SEQ ID NO: 1064 - RNA, 19 nt, Artificial Sequence
  Description of Artificial Sequence: Synthetic oligonucleotide
cagaagaauggaacaugaa

SEQ ID NO: 1065 - RNA, 19 nt, Artificial Sequence
  Description of Artificial Sequence: Synthetic oligonucleotide
ucauguuccauucuucugc

SEQ ID NO: 1066 - RNA, 19 nt, Artificial Sequence
  Description of Artificial Sequence: Synthetic oligonucleotide
gcagaagaauggaacauga

SEQ ID NO: 1067 - RNA, 19 nt, Artificial Sequence
  Description of Artificial Sequence: Synthetic oligonucleotide
cauguuccauucuucugca

SEQ ID NO: 1068 - RNA, 19 nt, Artificial Sequence
  Description of Artificial Sequence: Synthetic oligonucleotide
ugcagaagaauggaacaug

SEQ ID NO: 1069 - RNA, 19 nt, Artificial Sequence
  Description of Artificial Sequence: Synthetic oligonucleotide
ucuucugcaaugguuaauu

SEQ ID NO: 1070 - RNA, 19 nt, Artificial Sequence
  Description of Artificial Sequence: Synthetic oligonucleotide
aauuaaccauugcagaaga

SEQ ID NO: 1071 - RNA, 19 nt, Artificial Sequence
  Description of Artificial Sequence: Synthetic oligonucleotide
uucugcaaugguuaauuca

SEQ ID NO: 1072 - RNA, 19 nt, Artificial Sequence
  Description of Artificial Sequence: Synthetic oligonucleotide
ugaauuaaccauugcagaa

SEQ ID NO: 1073 - RNA, 19 nt, Artificial Sequence
  Description of Artificial Sequence: Synthetic oligonucleotide
cauucacagaggauuuuac

SEQ ID NO: 1074 - RNA, 19 nt, Artificial Sequence
  Description of Artificial Sequence: Synthetic oligonucleotide
guaaaauccucugugaaug

SEQ ID NO: 1075 - RNA, 19 nt, Artificial Sequence
  Description of Artificial Sequence: Synthetic oligonucleotide
auucacagaggauuuuacu

SEQ ID NO: 1076 - RNA, 19 nt, Artificial Sequence
  Description of Artificial Sequence: Synthetic oligonucleotide
aguaaaauccucugugaau

SEQ ID NO: 1077 - RNA, 19 nt, Artificial Sequence
  Description of Artificial Sequence: Synthetic oligonucleotide
acagaggauuuuacugcuu

SEQ ID NO: 1078 - RNA, 19 nt, Artificial Sequence
  Description of Artificial Sequence: Synthetic oligonucleotide
aagcaguaaaauccucugu

SEQ ID NO: 1079 - RNA, 19 nt, Artificial Sequence
  Description of Artificial Sequence: Synthetic oligonucleotide
cagaggauuuuacugcuua

SEQ ID NO: 1080 - RNA, 19 nt, Artificial Sequence
  Description of Artificial Sequence: Synthetic oligonucleotide
uaagcaguaaaauccucug

SEQ ID NO: 1081 - RNA, 19 nt, Artificial Sequence
  Description of Artificial Sequence: Synthetic oligonucleotide
agaggauuuuacugcuuaa

SEQ ID NO: 1082 - RNA, 19 nt, Artificial Sequence
  Description of Artificial Sequence: Synthetic oligonucleotide
uuaagcaguaaaauccucu

SEQ ID NO: 1083 - RNA, 19 nt, Artificial Sequence
  Description of Artificial Sequence: Synthetic oligonucleotide
gaggauuuuacugcuuaac

SEQ ID NO: 1084 - RNA, 19 nt, Artificial Sequence
  Description of Artificial Sequence: Synthetic oligonucleotide
guuaagcaguaaaauccuc

SEQ ID NO: 1085 - RNA, 19 nt, Artificial Sequence
  Description of Artificial Sequence: Synthetic oligonucleotide
auaugcauuuguucucagu

SEQ ID NO: 1086 - RNA, 19 nt, Artificial Sequence
  Description of Artificial Sequence: Synthetic oligonucleotide
acugagaacaaaugcauau

SEQ ID NO: 1087 - RNA, 19 nt, Artificial Sequence
  Description of Artificial Sequence: Synthetic oligonucleotide
augcauuuguucucaguuc

SEQ ID NO: 1088 - RNA, 19 nt, Artificial Sequence
  Description of Artificial Sequence: Synthetic oligonucleotide
gaacugagaacaaaugcau

SEQ ID NO: 1089 - RNA, 19 nt, Artificial Sequence
  Description of Artificial Sequence: Synthetic oligonucleotide
uuuguucucaguucucagu

SEQ ID NO: 1090 - RNA, 19 nt, Artificial Sequence
  Description of Artificial Sequence: Synthetic oligonucleotide
acugagaacugagaacaaa

SEQ ID NO: 1091 - RNA, 19 nt, Artificial Sequence
  Description of Artificial Sequence: Synthetic oligonucleotide
uuguucucaguucucagug

SEQ ID NO: 1092 - RNA, 19 nt, Artificial Sequence
  Description of Artificial Sequence: Synthetic oligonucleotide
cacugagaacugagaacaa

SEQ ID NO: 1093 - RNA, 19 nt, Artificial Sequence
  Description of Artificial Sequence: Synthetic oligonucleotide
guucucaguucucagugcc

SEQ ID NO: 1094 - RNA, 19 nt, Artificial Sequence
  Description of Artificial Sequence: Synthetic oligonucleotide
ggcacugagaacugagaac

SEQ ID NO: 1095 - RNA, 19 nt, Artificial Sequence
  Description of Artificial Sequence: Synthetic oligonucleotide
uucucaguucucagugcca

SEQ ID NO: 1096 - RNA, 19 nt, Artificial Sequence
  Description of Artificial Sequence: Synthetic oligonucleotide
uggcacugagaacugagaa

SEQ ID NO: 1097 - RNA, 19 nt, Artificial Sequence
  Description of Artificial Sequence: Synthetic oligonucleotide
caguucucagugccaucua

SEQ ID NO: 1098 - RNA, 19 nt, Artificial Sequence
  Description of Artificial Sequence: Synthetic oligonucleotide
uagauggcacugagaacug

SEQ ID NO: 1099 - RNA, 19 nt, Artificial Sequence
  Description of Artificial Sequence: Synthetic oligonucleotide
aguucucagugccaucuag

SEQ ID NO: 1100 - RNA, 19 nt, Artificial Sequence
  Description of Artificial Sequence: Synthetic oligonucleotide
cuagauggcacugagaacu

SEQ ID NO: 1101 - RNA, 19 nt, Artificial Sequence
  Description of Artificial Sequence: Synthetic oligonucleotide
ucagugccaucuaguuauc

SEQ ID NO: 1102 - RNA, 19 nt, Artificial Sequence
  Description of Artificial Sequence: Synthetic oligonucleotide
gauaacuagauggcacuga

SEQ ID NO: 1103 - RNA, 19 nt, Artificial Sequence
  Description of Artificial Sequence: Synthetic oligonucleotide
cagugccaucuaguuauca

SEQ ID NO: 1104 - RNA, 19 nt, Artificial Sequence
  Description of Artificial Sequence: Synthetic oligonucleotide
ugauaacuagauggcacug

SEQ ID NO: 1105 - RNA, 19 nt, Artificial Sequence
  Description of Artificial Sequence: Synthetic oligonucleotide
agugccaucuaguuaucac

SEQ ID NO: 1106 - RNA, 19 nt, Artificial Sequence
  Description of Artificial Sequence: Synthetic oligonucleotide
gugauaacuagauggcacu

SEQ ID NO: 1107 - RNA, 19 nt, Artificial Sequence
  Description of Artificial Sequence: Synthetic oligonucleotide
gugccaucuaguuaucacu

SEQ ID NO: 1108 - RNA, 19 nt, Artificial Sequence
  Description of Artificial Sequence: Synthetic oligonucleotide
agugauaacuagauggcac

SEQ ID NO: 1109 - RNA, 19 nt, Artificial Sequence
  Description of Artificial Sequence: Synthetic oligonucleotide
ugccaucuaguuaucacuu

SEQ ID NO: 1110 - RNA, 19 nt, Artificial Sequence
  Description of Artificial Sequence: Synthetic oligonucleotide
aagugauaacuagauggca

SEQ ID NO: 1111 - RNA, 19 nt, Artificial Sequence
  Description of Artificial Sequence: Synthetic oligonucleotide
gccaucuaguuaucacuuc

SEQ ID NO: 1112 - RNA, 19 nt, Artificial Sequence
  Description of Artificial Sequence: Synthetic oligonucleotide
gaagugauaacuagauggc

SEQ ID NO: 1113 - RNA, 19 nt, Artificial Sequence
  Description of Artificial Sequence: Synthetic oligonucleotide
ccaucuaguuaucacuuca

SEQ ID NO: 1114 - RNA, 19 nt, Artificial Sequence
  Description of Artificial Sequence: Synthetic oligonucleotide
ugaagugauaacuagaugg

SEQ ID NO: 1115 - RNA, 19 nt, Artificial Sequence
  Description of Artificial Sequence: Synthetic oligonucleotide
caucuaguuaucacuucac

SEQ ID NO: 1116 - RNA, 19 nt, Artificial Sequence
  Description of Artificial Sequence: Synthetic oligonucleotide
gugaagugauaacuagaug

SEQ ID NO: 1117 - RNA, 19 nt, Artificial Sequence
  Description of Artificial Sequence: Synthetic oligonucleotide
aucuaguuaucacuucacu

SEQ ID NO: 1118 - RNA, 19 nt, Artificial Sequence
  Description of Artificial Sequence: Synthetic oligonucleotide
agugaagugauaacuagau

SEQ ID NO: 1119 - RNA, 19 nt, Artificial Sequence
  Description of Artificial Sequence: Synthetic oligonucleotide
ucuaguuaucacuucacug

SEQ ID NO: 1120 - RNA, 19 nt, Artificial Sequence
  Description of Artificial Sequence: Synthetic oligonucleotide
cagugaagugauaacuaga

SEQ ID NO: 1121 - RNA, 19 nt, Artificial Sequence
  Description of Artificial Sequence: Synthetic oligonucleotide
cuaguuaucacuucacuga

SEQ ID NO: 1122 - RNA, 19 nt, Artificial Sequence
  Description of Artificial Sequence: Synthetic oligonucleotide
ucagugaagugauaacuag

SEQ ID NO: 1123 - RNA, 19 nt, Artificial Sequence
  Description of Artificial Sequence: Synthetic oligonucleotide
uaguuaucacuucacugag

SEQ ID NO: 1124 - RNA, 19 nt, Artificial Sequence
  Description of Artificial Sequence: Synthetic oligonucleotide
cucagugaagugauaacua

SEQ ID NO: 1125 - RNA, 19 nt, Artificial Sequence
  Description of Artificial Sequence: Synthetic oligonucleotide
aguuaucacuucacugagg

SEQ ID NO: 1126 - RNA, 19 nt, Artificial Sequence
  Description of Artificial Sequence: Synthetic oligonucleotide
ccucagugaagugauaacu

SEQ ID NO: 1127 - RNA, 19 nt, Artificial Sequence
  Description of Artificial Sequence: Synthetic oligonucleotide
guuaucacuucacugagga

SEQ ID NO: 1128 - RNA, 19 nt, Artificial Sequence
  Description of Artificial Sequence: Synthetic oligonucleotide
uccucagugaagugauaac

SEQ ID NO: 1129 - RNA, 19 nt, Artificial Sequence
  Description of Artificial Sequence: Synthetic oligonucleotide
uuaucacuucacugaggau

SEQ ID NO: 1130 - RNA, 19 nt, Artificial Sequence
  Description of Artificial Sequence: Synthetic oligonucleotide
auccucagugaagugauaa

SEQ ID NO: 1131 - RNA, 19 nt, Artificial Sequence
  Description of Artificial Sequence: Synthetic oligonucleotide
uaucacuucacugaggauc

SEQ ID NO: 1132 - RNA, 19 nt, Artificial Sequence
  Description of Artificial Sequence: Synthetic oligonucleotide
gauccucagugaagugaua

SEQ ID NO: 1133 - RNA, 19 nt, Artificial Sequence
  Description of Artificial Sequence: Synthetic oligonucleotide
aucacuucacugaggaucc

SEQ ID NO: 1134 - RNA, 19 nt, Artificial Sequence
  Description of Artificial Sequence: Synthetic oligonucleotide
ggauccucagugaagugau

SEQ ID NO: 1135 - RNA, 19 nt, Artificial Sequence
  Description of Artificial Sequence: Synthetic oligonucleotide
ucacuucacugaggauccu

SEQ ID NO: 1136 - RNA, 19 nt, Artificial Sequence
  Description of Artificial Sequence: Synthetic oligonucleotide
aggauccucagugaaguga

SEQ ID NO: 1137 - RNA, 19 nt, Artificial Sequence
  Description of Artificial Sequence: Synthetic oligonucleotide
gcuuucccaguagccacua

SEQ ID NO: 1138 - RNA, 19 nt, Artificial Sequence
  Description of Artificial Sequence: Synthetic oligonucleotide
uaguggcuacugggaaagc

SEQ ID NO: 1139 - RNA, 19 nt, Artificial Sequence
  Description of Artificial Sequence: Synthetic oligonucleotide
cuuucccaguagccacuaa

SEQ ID NO: 1140 - RNA, 19 nt, Artificial Sequence
  Description of Artificial Sequence: Synthetic oligonucleotide
uuaguggcuacugggaaag

SEQ ID NO: 1141 - RNA, 19 nt, Artificial Sequence
  Description of Artificial Sequence: Synthetic oligonucleotide
uuucccaguagccacuaau

SEQ ID NO: 1142 - RNA, 19 nt, Artificial Sequence
  Description of Artificial Sequence: Synthetic oligonucleotide
auuaguggcuacugggaaa

SEQ ID NO: 1143 - RNA, 19 nt, Artificial Sequence
  Description of Artificial Sequence: Synthetic oligonucleotide
uucccaguagccacuaaug

SEQ ID NO: 1144 - RNA, 19 nt, Artificial Sequence
  Description of Artificial Sequence: Synthetic oligonucleotide
cauuaguggcuacugggaa

SEQ ID NO: 1145 - RNA, 19 nt, Artificial Sequence
  Description of Artificial Sequence: Synthetic oligonucleotide
ucccaguagccacuaaugg

SEQ ID NO: 1146 - RNA, 19 nt, Artificial Sequence
  Description of Artificial Sequence: Synthetic oligonucleotide
ccauuaguggcuacuggga

SEQ ID NO: 1147 - RNA, 19 nt, Artificial Sequence
  Description of Artificial Sequence: Synthetic oligonucleotide
cuuggcaggagcuaaggcu

SEQ ID NO: 1148 - RNA, 19 nt, Artificial Sequence
  Description of Artificial Sequence: Synthetic oligonucleotide
agccuuagcuccugccaag

SEQ ID NO: 1149 - RNA, 19 nt, Artificial Sequence
  Description of Artificial Sequence: Synthetic oligonucleotide
ccaguguggucauuccucu

SEQ ID NO: 1150 - RNA, 19 nt, Artificial Sequence
  Description of Artificial Sequence: Synthetic oligonucleotide
agaggaaugaccacacugg

SEQ ID NO: 1151 - RNA, 19 nt, Artificial Sequence
  Description of Artificial Sequence: Synthetic oligonucleotide
gucauuccucuccauuaug

SEQ ID NO: 1152 - RNA, 19 nt, Artificial Sequence
  Description of Artificial Sequence: Synthetic oligonucleotide
cauaauggagaggaaugac

SEQ ID NO: 1153 - RNA, 19 nt, Artificial Sequence
  Description of Artificial Sequence: Synthetic oligonucleotide
cauuccucuccauuaugac

SEQ ID NO: 1154 - RNA, 19 nt, Artificial Sequence
  Description of Artificial Sequence: Synthetic oligonucleotide
gucauaauggagaggaaug

SEQ ID NO: 1155 - RNA, 19 nt, Artificial Sequence
  Description of Artificial Sequence: Synthetic oligonucleotide
auuccucuccauuaugacc

SEQ ID NO: 1156 - RNA, 19 nt, Artificial Sequence
  Description of Artificial Sequence: Synthetic oligonucleotide
ggucauaauggagaggaau

SEQ ID NO: 1157 - RNA, 19 nt, Artificial Sequence
  Description of Artificial Sequence: Synthetic oligonucleotide
cucuccauuaugaccucuu

SEQ ID NO: 1158 - RNA, 19 nt, Artificial Sequence
  Description of Artificial Sequence: Synthetic oligonucleotide
aagaggucauaauggagag

SEQ ID NO: 1159 - RNA, 19 nt, Artificial Sequence
  Description of Artificial Sequence: Synthetic oligonucleotide
ucuccauuaugaccucuuu

SEQ ID NO: 1160 - RNA, 19 nt, Artificial Sequence
  Description of Artificial Sequence: Synthetic oligonucleotide
aaagaggucauaauggaga

SEQ ID NO: 1161 - RNA, 19 nt, Artificial Sequence
  Description of Artificial Sequence: Synthetic oligonucleotide
cuccauuaugaccucuuug

SEQ ID NO: 1162 - RNA, 19 nt, Artificial Sequence
  Description of Artificial Sequence: Synthetic oligonucleotide
caaagaggucauaauggag

SEQ ID NO: 1163 - RNA, 19 nt, Artificial Sequence
  Description of Artificial Sequence: Synthetic oligonucleotide
uccauuaugaccucuuugu

SEQ ID NO: 1164 - RNA, 19 nt, Artificial Sequence
  Description of Artificial Sequence: Synthetic oligonucleotide
acaaagaggucauaaugga

SEQ ID NO: 1165 - RNA, 19 nt, Artificial Sequence
  Description of Artificial Sequence: Synthetic oligonucleotide
ccauuaugaccucuuuguc

SEQ ID NO: 1166 - RNA, 19 nt, Artificial Sequence
  Description of Artificial Sequence: Synthetic oligonucleotide
gacaaagaggucauaaugg

SEQ ID NO: 1167 - RNA, 19 nt, Artificial Sequence
  Description of Artificial Sequence: Synthetic oligonucleotide
cauuaugaccucuuugucc

SEQ ID NO: 1168 - RNA, 19 nt, Artificial Sequence
  Description of Artificial Sequence: Synthetic oligonucleotide
ggacaaagaggucauaaug

SEQ ID NO: 1169 - RNA, 19 nt, Artificial Sequence
  Description of Artificial Sequence: Synthetic oligonucleotide
cccaaucucaccucucugg

SEQ ID NO: 1170 - RNA, 19 nt, Artificial Sequence
  Description of Artificial Sequence: Synthetic oligonucleotide
ccagagaggugagauuggg

SEQ ID NO: 1171 - RNA, 19 nt, Artificial Sequence
  Description of Artificial Sequence: Synthetic oligonucleotide
ucucaccucucuggacuuu

SEQ ID NO: 1172 - RNA, 19 nt, Artificial Sequence
  Description of Artificial Sequence: Synthetic oligonucleotide
aaaguccagagaggugaga

SEQ ID NO: 1173 - RNA, 19 nt, Artificial Sequence
  Description of Artificial Sequence: Synthetic oligonucleotide
cucaccucucuggacuuug

SEQ ID NO: 1174 - RNA, 19 nt, Artificial Sequence
  Description of Artificial Sequence: Synthetic oligonucleotide
caaaguccagagaggugag

SEQ ID NO: 1175 - RNA, 19 nt, Artificial Sequence
  Description of Artificial Sequence: Synthetic oligonucleotide
ucaccucucuggacuuugu

SEQ ID NO: 1176 - RNA, 19 nt, Artificial Sequence
  Description of Artificial Sequence: Synthetic oligonucleotide
acaaaguccagagagguga

SEQ ID NO: 1177 - RNA, 19 nt, Artificial Sequence
  Description of Artificial Sequence: Synthetic oligonucleotide
ucucuggacuuuguugcau

SEQ ID NO: 1178 - RNA, 19 nt, Artificial Sequence
  Description of Artificial Sequence: Synthetic oligonucleotide
augcaacaaaguccagaga

SEQ ID NO: 1179 - RNA, 19 nt, Artificial Sequence
  Description of Artificial Sequence: Synthetic oligonucleotide
cucuggacuuuguugcauc

SEQ ID NO: 1180 - RNA, 19 nt, Artificial Sequence
  Description of Artificial Sequence: Synthetic oligonucleotide
gaugcaacaaaguccagag

SEQ ID NO: 1181 - RNA, 19 nt, Artificial Sequence
  Description of Artificial Sequence: Synthetic oligonucleotide
cuggacuuuguugcaucug

SEQ ID NO: 1182 - RNA, 19 nt, Artificial Sequence
  Description of Artificial Sequence: Synthetic oligonucleotide
cagaugcaacaaaguccag

SEQ ID NO: 1183 - RNA, 19 nt, Artificial Sequence
  Description of Artificial Sequence: Synthetic oligonucleotide
ggacuuuguugcaucugag

SEQ ID NO: 1184 - RNA, 19 nt, Artificial Sequence
  Description of Artificial Sequence: Synthetic oligonucleotide
cucagaugcaacaaagucc

SEQ ID NO: 1185 - RNA, 19 nt, Artificial Sequence
  Description of Artificial Sequence: Synthetic oligonucleotide
gaagucuuggucagcaaug

SEQ ID NO: 1186 - RNA, 19 nt, Artificial Sequence
  Description of Artificial Sequence: Synthetic oligonucleotide
cauugcugaccaagacuuc

SEQ ID NO: 1187 - RNA, 19 nt, Artificial Sequence
  Description of Artificial Sequence: Synthetic oligonucleotide
aagucuuggucagcaaugc

SEQ ID NO: 1188 - RNA, 19 nt, Artificial Sequence
  Description of Artificial Sequence: Synthetic oligonucleotide
gcauugcugaccaagacuu

SEQ ID NO: 1189 - RNA, 19 nt, Artificial Sequence
  Description of Artificial Sequence: Synthetic oligonucleotide
agucuuggucagcaaugcu

SEQ ID NO: 1190 - RNA, 19 nt, Artificial Sequence
  Description of Artificial Sequence: Synthetic oligonucleotide
agcauugcugaccaagacu

SEQ ID NO: 1191 - RNA, 19 nt, Artificial Sequence
  Description of Artificial Sequence: Synthetic oligonucleotide
gucuuggucagcaaugcua

SEQ ID NO: 1192 - RNA, 19 nt, Artificial Sequence
  Description of Artificial Sequence: Synthetic oligonucleotide
uagcauugcugaccaagac

SEQ ID NO: 1193 - RNA, 19 nt, Artificial Sequence
  Description of Artificial Sequence: Synthetic oligonucleotide
ucuuggucagcaaugcuac

SEQ ID NO: 1194 - RNA, 19 nt, Artificial Sequence
  Description of Artificial Sequence: Synthetic oligonucleotide
guagcauugcugaccaaga

SEQ ID NO: 1195 - RNA, 19 nt, Artificial Sequence
  Description of Artificial Sequence: Synthetic oligonucleotide
cuuggucagcaaugcuacc

SEQ ID NO: 1196 - RNA, 19 nt, Artificial Sequence
  Description of Artificial Sequence: Synthetic oligonucleotide
gguagcauugcugaccaag

SEQ ID NO: 1197 - RNA, 19 nt, Artificial Sequence
  Description of Artificial Sequence: Synthetic oligonucleotide
uuggucagcaaugcuaccc

SEQ ID NO: 1198 - RNA, 19 nt, Artificial Sequence
  Description of Artificial Sequence: Synthetic oligonucleotide
ggguagcauugcugaccaa

SEQ ID NO: 1199 - RNA, 19 nt, Artificial Sequence
  Description of Artificial Sequence: Synthetic oligonucleotide
uggucagcaaugcuaccca

SEQ ID NO: 1200 - RNA, 19 nt, Artificial Sequence
  Description of Artificial Sequence: Synthetic oligonucleotide
uggguagcauugcugacca

SEQ ID NO: 1201 - RNA, 19 nt, Artificial Sequence
  Description of Artificial Sequence: Synthetic oligonucleotide
ggucagcaaugcuacccag

SEQ ID NO: 1202 - RNA, 19 nt, Artificial Sequence
  Description of Artificial Sequence: Synthetic oligonucleotide
cuggguagcauugcugacc

SEQ ID NO: 1203 - RNA, 19 nt, Artificial Sequence
  Description of Artificial Sequence: Synthetic oligonucleotide
gucagcaaugcuacccagu

SEQ ID NO: 1204 - RNA, 19 nt, Artificial Sequence
  Description of Artificial Sequence: Synthetic oligonucleotide
acuggguagcauugcugac

SEQ ID NO: 1205 - RNA, 19 nt, Artificial Sequence
  Description of Artificial Sequence: Synthetic oligonucleotide
ucagcaaugcuacccaguu

SEQ ID NO: 1206 - RNA, 19 nt, Artificial Sequence
  Description of Artificial Sequence: Synthetic oligonucleotide
aacuggguagcauugcuga

SEQ ID NO: 1207 - RNA, 19 nt, Artificial Sequence
  Description of Artificial Sequence: Synthetic oligonucleotide
cagcaaugcuacccaguuu

SEQ ID NO: 1208 - RNA, 19 nt, Artificial Sequence
  Description of Artificial Sequence: Synthetic oligonucleotide
aaacuggguagcauugcug

SEQ ID NO: 1209 - RNA, 19 nt, Artificial Sequence
  Description of Artificial Sequence: Synthetic oligonucleotide
agcaaugcuacccaguuua

SEQ ID NO: 1210 - RNA, 19 nt, Artificial Sequence
  Description of Artificial Sequence: Synthetic oligonucleotide
uaaacuggguagcauugcu

SEQ ID NO: 1211 - RNA, 19 nt, Artificial Sequence
  Description of Artificial Sequence: Synthetic oligonucleotide
caaugcuacccaguuuauc

SEQ ID NO: 1212 - RNA, 19 nt, Artificial Sequence
  Description of Artificial Sequence: Synthetic oligonucleotide
gauaaacuggguagcauug

SEQ ID NO: 1213 - RNA, 19 nt, Artificial Sequence
  Description of Artificial Sequence: Synthetic oligonucleotide
aaugcuacccaguuuauca

SEQ ID NO: 1214 - RNA, 19 nt, Artificial Sequence
  Description of Artificial Sequence: Synthetic oligonucleotide
ugauaaacuggguagcauu

SEQ ID NO: 1215 - RNA, 19 nt, Artificial Sequence
  Description of Artificial Sequence: Synthetic oligonucleotide
augcuacccaguuuaucau

SEQ ID NO: 1216 - RNA, 19 nt, Artificial Sequence
  Description of Artificial Sequence: Synthetic oligonucleotide
augauaaacuggguagcau

SEQ ID NO: 1217 - RNA, 19 nt, Artificial Sequence
  Description of Artificial Sequence: Synthetic oligonucleotide
ugcuacccaguuuaucauc

SEQ ID NO: 1218 - RNA, 19 nt, Artificial Sequence
  Description of Artificial Sequence: Synthetic oligonucleotide
gaugauaaacuggguagca

SEQ ID NO: 1219 - RNA, 19 nt, Artificial Sequence
  Description of Artificial Sequence: Synthetic oligonucleotide
gcuacccaguuuaucaucu

SEQ ID NO: 1220 - RNA, 19 nt, Artificial Sequence
  Description of Artificial Sequence: Synthetic oligonucleotide
agaugauaaacuggguagc

SEQ ID NO: 1221 - RNA, 19 nt, Artificial Sequence
  Description of Artificial Sequence: Synthetic oligonucleotide
cuacccaguuuaucaucuu

SEQ ID NO: 1222 - RNA, 19 nt, Artificial Sequence
  Description of Artificial Sequence: Synthetic oligonucleotide
aagaugauaaacuggguag

SEQ ID NO: 1223 - RNA, 19 nt, Artificial Sequence
  Description of Artificial Sequence: Synthetic oligonucleotide
uacccaguuuaucaucuug

SEQ ID NO: 1224 - RNA, 19 nt, Artificial Sequence
  Description of Artificial Sequence: Synthetic oligonucleotide
caagaugauaaacugggua

SEQ ID NO: 1225 - RNA, 19 nt, Artificial Sequence
  Description of Artificial Sequence: Synthetic oligonucleotide
acccaguuuaucaucuugc

SEQ ID NO: 1226 - RNA, 19 nt, Artificial Sequence
  Description of Artificial Sequence: Synthetic oligonucleotide
gcaagaugauaaacugggu

SEQ ID NO: 1227 - RNA, 19 nt, Artificial Sequence
  Description of Artificial Sequence: Synthetic oligonucleotide
cccaguuuaucaucuugca

SEQ ID NO: 1228 - RNA, 19 nt, Artificial Sequence
  Description of Artificial Sequence: Synthetic oligonucleotide
ugcaagaugauaaacuggg

SEQ ID NO: 1229 - RNA, 19 nt, Artificial Sequence
  Description of Artificial Sequence: Synthetic oligonucleotide
guuuaucaucuugcacagc

SEQ ID NO: 1230 - RNA, 19 nt, Artificial Sequence
  Description of Artificial Sequence: Synthetic oligonucleotide
gcugugcaagaugauaaac

SEQ ID NO: 1231 - RNA, 19 nt, Artificial Sequence
  Description of Artificial Sequence: Synthetic oligonucleotide
uuuaucaucuugcacagca

SEQ ID NO: 1232 - RNA, 19 nt, Artificial Sequence
  Description of Artificial Sequence: Synthetic oligonucleotide
ugcugugcaagaugauaaa

SEQ ID NO: 1233 - RNA, 19 nt, Artificial Sequence
  Description of Artificial Sequence: Synthetic oligonucleotide
ucacgaaugccacccuuca

SEQ ID NO: 1234 - RNA, 19 nt, Artificial Sequence
  Description of Artificial Sequence: Synthetic oligonucleotide
ugaaggguggcauucguga

SEQ ID NO: 1235 - RNA, 19 nt, Artificial Sequence
  Description of Artificial Sequence: Synthetic oligonucleotide
cacgaaugccacccuucag

SEQ ID NO: 1236 - RNA, 19 nt, Artificial Sequence
  Description of Artificial Sequence: Synthetic oligonucleotide
cugaaggguggcauucgug

SEQ ID NO: 1237 - RNA, 19 nt, Artificial Sequence
  Description of Artificial Sequence: Synthetic oligonucleotide
acgaaugccacccuucagu

SEQ ID NO: 1238 - RNA, 19 nt, Artificial Sequence
  Description of Artificial Sequence: Synthetic oligonucleotide
acugaaggguggcauucgu

SEQ ID NO: 1239 - RNA, 19 nt, Artificial Sequence
  Description of Artificial Sequence: Synthetic oligonucleotide
cgaaugccacccuucaguc

SEQ ID NO: 1240 - RNA, 19 nt, Artificial Sequence
  Description of Artificial Sequence: Synthetic oligonucleotide
gacugaaggguggcauucg

SEQ ID NO: 1241 - RNA, 19 nt, Artificial Sequence
  Description of Artificial Sequence: Synthetic oligonucleotide
gaaugccacccuucaguca

SEQ ID NO: 1242 - RNA, 19 nt, Artificial Sequence
  Description of Artificial Sequence: Synthetic oligonucleotide
ugacugaaggguggcauuc

SEQ ID NO: 1243 - RNA, 19 nt, Artificial Sequence
  Description of Artificial Sequence: Synthetic oligonucleotide
uucagucagaggaagauuc

SEQ ID NO: 1244 - RNA, 19 nt, Artificial Sequence
  Description of Artificial Sequence: Synthetic oligonucleotide
gaaucuuccucugacugaa

SEQ ID NO: 1245 - RNA, 19 nt, Artificial Sequence
  Description of Artificial Sequence: Synthetic oligonucleotide
ucagucagaggaagauuca

SEQ ID NO: 1246 - RNA, 19 nt, Artificial Sequence
  Description of Artificial Sequence: Synthetic oligonucleotide
ugaaucuuccucugacuga

SEQ ID NO: 1247 - RNA, 19 nt, Artificial Sequence
  Description of Artificial Sequence: Synthetic oligonucleotide
cagucagaggaagauucaa

SEQ ID NO: 1248 - RNA, 19 nt, Artificial Sequence
  Description of Artificial Sequence: Synthetic oligonucleotide
uugaaucuuccucugacug

SEQ ID NO: 1249 - RNA, 19 nt, Artificial Sequence
  Description of Artificial Sequence: Synthetic oligonucleotide
agucagaggaagauucaag

SEQ ID NO: 1250 - RNA, 19 nt, Artificial Sequence
  Description of Artificial Sequence: Synthetic oligonucleotide
cuugaaucuuccucugacu

SEQ ID NO: 1251 - RNA, 19 nt, Artificial Sequence
  Description of Artificial Sequence: Synthetic oligonucleotide
gucagaggaagauucaaga

SEQ ID NO: 1252 - RNA, 19 nt, Artificial Sequence
  Description of Artificial Sequence: Synthetic oligonucleotide
ucuugaaucuuccucugac

SEQ ID NO: 1253 - RNA, 19 nt, Artificial Sequence
  Description of Artificial Sequence: Synthetic oligonucleotide
cagaggaagauucaagaua

SEQ ID NO: 1254 - RNA, 19 nt, Artificial Sequence
  Description of Artificial Sequence: Synthetic oligonucleotide
uaucuugaaucuuccucug

SEQ ID NO: 1255 - RNA, 19 nt, Artificial Sequence
  Description of Artificial Sequence: Synthetic oligonucleotide
agaggaagauucaagauac

SEQ ID NO: 1256 - RNA, 19 nt, Artificial Sequence
  Description of Artificial Sequence: Synthetic oligonucleotide
guaucuugaaucuuccucu

SEQ ID NO: 1257 - RNA, 19 nt, Artificial Sequence
  Description of Artificial Sequence: Synthetic oligonucleotide
gaggaagauucaagauaca

SEQ ID NO: 1258 - RNA, 19 nt, Artificial Sequence
  Description of Artificial Sequence: Synthetic oligonucleotide
uguaucuugaaucuuccuc

SEQ ID NO: 1259 - RNA, 19 nt, Artificial Sequence
  Description of Artificial Sequence: Synthetic oligonucleotide
aggaagauucaagauacau

SEQ ID NO: 1260 - RNA, 19 nt, Artificial Sequence
  Description of Artificial Sequence: Synthetic oligonucleotide
auguaucuugaaucuuccu

SEQ ID NO: 1261 - RNA, 19 nt, Artificial Sequence
  Description of Artificial Sequence: Synthetic oligonucleotide
ggaagauucaagauacaug

SEQ ID NO: 1262 - RNA, 19 nt, Artificial Sequence
  Description of Artificial Sequence: Synthetic oligonucleotide
cauguaucuugaaucuucc

SEQ ID NO: 1263 - RNA, 19 nt, Artificial Sequence
  Description of Artificial Sequence: Synthetic oligonucleotide
gaagauucaagauacauga

SEQ ID NO: 1264 - RNA, 19 nt, Artificial Sequence
  Description of Artificial Sequence: Synthetic oligonucleotide
ucauguaucuugaaucuuc

SEQ ID NO: 1265 - RNA, 19 nt, Artificial Sequence
  Description of Artificial Sequence: Synthetic oligonucleotide
aaaguuuugaguuacccug

SEQ ID NO: 1266 - RNA, 19 nt, Artificial Sequence
  Description of Artificial Sequence: Synthetic oligonucleotide
caggguaacucaaaacuuu

SEQ ID NO: 1267 - RNA, 19 nt, Artificial Sequence
  Description of Artificial Sequence: Synthetic oligonucleotide
caaauugcacugcugguuc

SEQ ID NO: 1268 - RNA, 19 nt, Artificial Sequence
  Description of Artificial Sequence: Synthetic oligonucleotide
gaaccagcagugcaauuug

SEQ ID NO: 1269 - RNA, 19 nt, Artificial Sequence
  Description of Artificial Sequence: Synthetic oligonucleotide
aaauugcacugcugguucc

SEQ ID NO: 1270 - RNA, 19 nt, Artificial Sequence
  Description of Artificial Sequence: Synthetic oligonucleotide
ggaaccagcagugcaauuu

SEQ ID NO: 1271 - RNA, 19 nt, Artificial Sequence
  Description of Artificial Sequence: Synthetic oligonucleotide
aauugcacugcugguucca

SEQ ID NO: 1272 - RNA, 19 nt, Artificial Sequence
  Description of Artificial Sequence: Synthetic oligonucleotide
uggaaccagcagugcaauu

SEQ ID NO: 1273 - RNA, 19 nt, Artificial Sequence
  Description of Artificial Sequence: Synthetic oligonucleotide
auugcacugcugguuccag

SEQ ID NO: 1274 - RNA, 19 nt, Artificial Sequence
  Description of Artificial Sequence: Synthetic oligonucleotide
cuggaaccagcagugcaau

SEQ ID NO: 1275 - RNA, 19 nt, Artificial Sequence
  Description of Artificial Sequence: Synthetic oligonucleotide
uugcacugcugguuccaga

SEQ ID NO: 1276 - RNA, 19 nt, Artificial Sequence
  Description of Artificial Sequence: Synthetic oligonucleotide
ucuggaaccagcagugcaa

SEQ ID NO: 1277 - RNA, 19 nt, Artificial Sequence
  Description of Artificial Sequence: Synthetic oligonucleotide
aaauacuauguggcuaugg

SEQ ID NO: 1278 - RNA, 19 nt, Artificial Sequence
  Description of Artificial Sequence: Synthetic oligonucleotide
ccauagccacauaguauuu

SEQ ID NO: 1279 - RNA, 19 nt, Artificial Sequence
  Description of Artificial Sequence: Synthetic oligonucleotide
aauacuauguggcuaugga

SEQ ID NO: 1280 - RNA, 19 nt, Artificial Sequence
  Description of Artificial Sequence: Synthetic oligonucleotide
uccauagccacauaguauu

SEQ ID NO: 1281 - RNA, 19 nt, Artificial Sequence
  Description of Artificial Sequence: Synthetic oligonucleotide
auacuauguggcuauggac

SEQ ID NO: 1282 - RNA, 19 nt, Artificial Sequence
  Description of Artificial Sequence: Synthetic oligonucleotide
guccauagccacauaguau

SEQ ID NO: 1283 - RNA, 19 nt, Artificial Sequence
  Description of Artificial Sequence: Synthetic oligonucleotide
uacuauguggcuauggacu

SEQ ID NO: 1284 - RNA, 19 nt, Artificial Sequence
  Description of Artificial Sequence: Synthetic oligonucleotide
aguccauagccacauagua

SEQ ID NO: 1285 - RNA, 19 nt, Artificial Sequence
  Description of Artificial Sequence: Synthetic oligonucleotide
acuauguggcuauggacuu

SEQ ID NO: 1286 - RNA, 19 nt, Artificial Sequence
  Description of Artificial Sequence: Synthetic oligonucleotide
aaguccauagccacauagu

SEQ ID NO: 1287 - RNA, 19 nt, Artificial Sequence
  Description of Artificial Sequence: Synthetic oligonucleotide
cuauguggcuauggacuuc

SEQ ID NO: 1288 - RNA, 19 nt, Artificial Sequence
  Description of Artificial Sequence: Synthetic oligonucleotide
gaaguccauagccacauag

SEQ ID NO: 1289 - RNA, 19 nt, Artificial Sequence
  Description of Artificial Sequence: Synthetic oligonucleotide
uauguggcuauggacuucc

SEQ ID NO: 1290 - RNA, 19 nt, Artificial Sequence
  Description of Artificial Sequence: Synthetic oligonucleotide
ggaaguccauagccacaua

SEQ ID NO: 1291 - RNA, 19 nt, Artificial Sequence
  Description of Artificial Sequence: Synthetic oligonucleotide
auguggcuauggacuucca

SEQ ID NO: 1292 - RNA, 19 nt, Artificial Sequence
  Description of Artificial Sequence: Synthetic oligonucleotide
uggaaguccauagccacau

SEQ ID NO: 1293 - RNA, 19 nt, Artificial Sequence
  Description of Artificial Sequence: Synthetic oligonucleotide
uguggcuauggacuuccaa

SEQ ID NO: 1294 - RNA, 19 nt, Artificial Sequence
  Description of Artificial Sequence: Synthetic oligonucleotide
uuggaaguccauagccaca

SEQ ID NO: 1295 - RNA, 19 nt, Artificial Sequence
  Description of Artificial Sequence: Synthetic oligonucleotide
guggcuauggacuuccaag

SEQ ID NO: 1296 - RNA, 19 nt, Artificial Sequence
  Description of Artificial Sequence: Synthetic oligonucleotide
cuuggaaguccauagccac

SEQ ID NO: 1297 - RNA, 19 nt, Artificial Sequence
  Description of Artificial Sequence: Synthetic oligonucleotide
uggcuauggacuuccaagc

SEQ ID NO: 1298 - RNA, 19 nt, Artificial Sequence
  Description of Artificial Sequence: Synthetic oligonucleotide
gcuuggaaguccauagcca

SEQ ID NO: 1299 - RNA, 19 nt, Artificial Sequence
  Description of Artificial Sequence: Synthetic oligonucleotide
gcuauggacuuccaagcca

SEQ ID NO: 1300 - RNA, 19 nt, Artificial Sequence
  Description of Artificial Sequence: Synthetic oligonucleotide
uggcuuggaaguccauagc

SEQ ID NO: 1301 - RNA, 19 nt, Artificial Sequence
  Description of Artificial Sequence: Synthetic oligonucleotide
cuauggacuuccaagccaa

SEQ ID NO: 1302 - RNA, 19 nt, Artificial Sequence
  Description of Artificial Sequence: Synthetic oligonucleotide
uuggcuuggaaguccauag

SEQ ID NO: 1303 - RNA, 19 nt, Artificial Sequence
  Description of Artificial Sequence: Synthetic oligonucleotide
uauggacuuccaagccaag

SEQ ID NO: 1304 - RNA, 19 nt, Artificial Sequence
  Description of Artificial Sequence: Synthetic oligonucleotide
cuuggcuuggaaguccaua

SEQ ID NO: 1305 - RNA, 19 nt, Artificial Sequence
  Description of Artificial Sequence: Synthetic oligonucleotide
cuuccaagccaaguuaggu

SEQ ID NO: 1306 - RNA, 19 nt, Artificial Sequence
  Description of Artificial Sequence: Synthetic oligonucleotide
accuaacuuggcuuggaag

SEQ ID NO: 1307 - RNA, 19 nt, Artificial Sequence
  Description of Artificial Sequence: Synthetic oligonucleotide
uuccaagccaaguuaggug

SEQ ID NO: 1308 - RNA, 19 nt, Artificial Sequence
  Description of Artificial Sequence: Synthetic oligonucleotide
caccuaacuuggcuuggaa

SEQ ID NO: 1309 - RNA, 19 nt, Artificial Sequence
  Description of Artificial Sequence: Synthetic oligonucleotide
uccaagccaaguuagguga

SEQ ID NO: 1310 - RNA, 19 nt, Artificial Sequence
  Description of Artificial Sequence: Synthetic oligonucleotide
ucaccuaacuuggcuugga

SEQ ID NO: 1311 - RNA, 19 nt, Artificial Sequence
  Description of Artificial Sequence: Synthetic oligonucleotide
ccaagccaaguuaggugau

SEQ ID NO: 1312 - RNA, 19 nt, Artificial Sequence
  Description of Artificial Sequence: Synthetic oligonucleotide
aucaccuaacuuggcuugg

SEQ ID NO: 1313 - RNA, 19 nt, Artificial Sequence
  Description of Artificial Sequence: Synthetic oligonucleotide
caagccaaguuaggugaug

SEQ ID NO: 1314 - RNA, 19 nt, Artificial Sequence
  Description of Artificial Sequence: Synthetic oligonucleotide
caucaccuaacuuggcuug

SEQ ID NO: 1315 - RNA, 19 nt, Artificial Sequence
  Description of Artificial Sequence: Synthetic oligonucleotide
aagccaaguuaggugaugg

SEQ ID NO: 1316 - RNA, 19 nt, Artificial Sequence
  Description of Artificial Sequence: Synthetic oligonucleotide
ccaucaccuaacuuggcuu

SEQ ID NO: 1317 - RNA, 19 nt, Artificial Sequence
  Description of Artificial Sequence: Synthetic oligonucleotide
ccaaguuaggugauggcuu

SEQ ID NO: 1318 - RNA, 19 nt, Artificial Sequence
  Description of Artificial Sequence: Synthetic oligonucleotide
aagccaucaccuaacuugg

SEQ ID NO: 1319 - RNA, 19 nt, Artificial Sequence
  Description of Artificial Sequence: Synthetic oligonucleotide
caaguuaggugauggcuuu

SEQ ID NO: 1320 - RNA, 19 nt, Artificial Sequence
  Description of Artificial Sequence: Synthetic oligonucleotide
aaagccaucaccuaacuug

SEQ ID NO: 1321 - RNA, 19 nt, Artificial Sequence
  Description of Artificial Sequence: Synthetic oligonucleotide
uuaggugauggcuuugaag

SEQ ID NO: 1322 - RNA, 19 nt, Artificial Sequence
  Description of Artificial Sequence: Synthetic oligonucleotide
cuucaaagccaucaccuaa

SEQ ID NO: 1323 - RNA, 19 nt, Artificial Sequence
  Description of Artificial Sequence: Synthetic oligonucleotide
gugauggcuuugaaggguu

SEQ ID NO: 1324 - RNA, 19 nt, Artificial Sequence
  Description of Artificial Sequence: Synthetic oligonucleotide
aacccuucaaagccaucac

SEQ ID NO: 1325 - RNA, 19 nt, Artificial Sequence
  Description of Artificial Sequence: Synthetic oligonucleotide
ugauggcuuugaaggguuu

SEQ ID NO: 1326 - RNA, 19 nt, Artificial Sequence
  Description of Artificial Sequence: Synthetic oligonucleotide
aaacccuucaaagccauca

SEQ ID NO: 1327 - RNA, 19 nt, Artificial Sequence
  Description of Artificial Sequence: Synthetic oligonucleotide
gauggcuuugaaggguuuu

SEQ ID NO: 1328 - RNA, 19 nt, Artificial Sequence
  Description of Artificial Sequence: Synthetic oligonucleotide
aaaacccuucaaagccauc

SEQ ID NO: 1329 - RNA, 19 nt, Artificial Sequence
  Description of Artificial Sequence: Synthetic oligonucleotide
auggcuuugaaggguuuua

SEQ ID NO: 1330 - RNA, 19 nt, Artificial Sequence
  Description of Artificial Sequence: Synthetic oligonucleotide
uaaaacccuucaaagccau

SEQ ID NO: 1331 - RNA, 19 nt, Artificial Sequence
  Description of Artificial Sequence: Synthetic oligonucleotide
uggcuuugaaggguuuuau

SEQ ID NO: 1332 - RNA, 19 nt, Artificial Sequence
  Description of Artificial Sequence: Synthetic oligonucleotide
auaaaacccuucaaagcca

SEQ ID NO: 1333 - RNA, 19 nt, Artificial Sequence
  Description of Artificial Sequence: Synthetic oligonucleotide
ugaaggguuuuauaaaagc

SEQ ID NO: 1334 - RNA, 19 nt, Artificial Sequence
  Description of Artificial Sequence: Synthetic oligonucleotide
gcuuuuauaaaacccuuca

SEQ ID NO: 1335 - RNA, 19 nt, Artificial Sequence
  Description of Artificial Sequence: Synthetic oligonucleotide
gaaggguuuuauaaaagca

SEQ ID NO: 1336 - RNA, 19 nt, Artificial Sequence
  Description of Artificial Sequence: Synthetic oligonucleotide
ugcuuuuauaaaacccuuc

SEQ ID NO: 1337 - RNA, 19 nt, Artificial Sequence
  Description of Artificial Sequence: Synthetic oligonucleotide
aaggguuuuauaaaagcac

SEQ ID NO: 1338 - RNA, 19 nt, Artificial Sequence
  Description of Artificial Sequence: Synthetic oligonucleotide
gugcuuuuauaaaacccuu

SEQ ID NO: 1339 - RNA, 19 nt, Artificial Sequence
  Description of Artificial Sequence: Synthetic oligonucleotide
agauuuugagccaacccag

SEQ ID NO: 1340 - RNA, 19 nt, Artificial Sequence
  Description of Artificial Sequence: Synthetic oligonucleotide
cuggguuggcucaaaaucu

SEQ ID NO: 1341 - RNA, 19 nt, Artificial Sequence
  Description of Artificial Sequence: Synthetic oligonucleotide
gauuuugagccaacccagg

SEQ ID NO: 1342 - RNA, 19 nt, Artificial Sequence
  Description of Artificial Sequence: Synthetic oligonucleotide
ccuggguuggcucaaaauc

SEQ ID NO: 1343 - RNA, 19 nt, Artificial Sequence
  Description of Artificial Sequence: Synthetic oligonucleotide
auuuugagccaacccaggc

SEQ ID NO: 1344 - RNA, 19 nt, Artificial Sequence
  Description of Artificial Sequence: Synthetic oligonucleotide
gccuggguuggcucaaaau

SEQ ID NO: 1345 - RNA, 19 nt, Artificial Sequence
  Description of Artificial Sequence: Synthetic oligonucleotide
agccaacccaggcacgcau

SEQ ID NO: 1346 - RNA, 19 nt, Artificial Sequence
  Description of Artificial Sequence: Synthetic oligonucleotide
augcgugccuggguuggcu

SEQ ID NO: 1347 - RNA, 19 nt, Artificial Sequence
  Description of Artificial Sequence: Synthetic oligonucleotide
aacccaggcacgcauggcu

SEQ ID NO: 1348 - RNA, 19 nt, Artificial Sequence
  Description of Artificial Sequence: Synthetic oligonucleotide
agccaugcgugccuggguu

SEQ ID NO: 1349 - RNA, 19 nt, Artificial Sequence
  Description of Artificial Sequence: Synthetic oligonucleotide
acccaggcacgcauggcuu

SEQ ID NO: 1350 - RNA, 19 nt, Artificial Sequence
  Description of Artificial Sequence: Synthetic oligonucleotide
aagccaugcgugccugggu

SEQ ID NO: 1351 - RNA, 19 nt, Artificial Sequence
  Description of Artificial Sequence: Synthetic oligonucleotide
cccaggcacgcauggcuuu

SEQ ID NO: 1352 - RNA, 19 nt, Artificial Sequence
  Description of Artificial Sequence: Synthetic oligonucleotide
aaagccaugcgugccuggg

SEQ ID NO: 1353 - RNA, 19 nt, Artificial Sequence
  Description of Artificial Sequence: Synthetic oligonucleotide
ccaggcacgcauggcuuuc

SEQ ID NO: 1354 - RNA, 19 nt, Artificial Sequence
  Description of Artificial Sequence: Synthetic oligonucleotide
gaaagccaugcgugccugg

SEQ ID NO: 1355 - RNA, 19 nt, Artificial Sequence
  Description of Artificial Sequence: Synthetic oligonucleotide
caggcacgcauggcuuucc

SEQ ID NO: 1356 - RNA, 19 nt, Artificial Sequence
  Description of Artificial Sequence: Synthetic oligonucleotide
ggaaagccaugcgugccug

SEQ ID NO: 1357 - RNA, 19 nt, Artificial Sequence
  Description of Artificial Sequence: Synthetic oligonucleotide
cacgcauggcuuucccuug

SEQ ID NO: 1358 - RNA, 19 nt, Artificial Sequence
  Description of Artificial Sequence: Synthetic oligonucleotide
caagggaaagccaugcgug

SEQ ID NO: 1359 - RNA, 19 nt, Artificial Sequence
  Description of Artificial Sequence: Synthetic oligonucleotide
cauggcuuucccuugcuuu

SEQ ID NO: 1360 - RNA, 19 nt, Artificial Sequence
  Description of Artificial Sequence: Synthetic oligonucleotide
aaagcaagggaaagccaug

SEQ ID NO: 1361 - RNA, 19 nt, Artificial Sequence
  Description of Artificial Sequence: Synthetic oligonucleotide
gcuuucccuugcuuugaug

SEQ ID NO: 1362 - RNA, 19 nt, Artificial Sequence
  Description of Artificial Sequence: Synthetic oligonucleotide
caucaaagcaagggaaagc

SEQ ID NO: 1363 - RNA, 19 nt, Artificial Sequence
  Description of Artificial Sequence: Synthetic oligonucleotide
cuuucccuugcuuugauga

SEQ ID NO: 1364 - RNA, 19 nt, Artificial Sequence
  Description of Artificial Sequence: Synthetic oligonucleotide
ucaucaaagcaagggaaag

SEQ ID NO: 1365 - RNA, 19 nt, Artificial Sequence
  Description of Artificial Sequence: Synthetic oligonucleotide
uuucccuugcuuugaugaa

SEQ ID NO: 1366 - RNA, 19 nt, Artificial Sequence
  Description of Artificial Sequence: Synthetic oligonucleotide
uucaucaaagcaagggaaa

SEQ ID NO: 1367 - RNA, 19 nt, Artificial Sequence
  Description of Artificial Sequence: Synthetic oligonucleotide
aagccaacuuuucaaucaa

SEQ ID NO: 1368 - RNA, 19 nt, Artificial Sequence
  Description of Artificial Sequence: Synthetic oligonucleotide
uugauugaaaaguuggcuu

SEQ ID NO: 1369 - RNA, 19 nt, Artificial Sequence
  Description of Artificial Sequence: Synthetic oligonucleotide
agccaacuuuucaaucaag

SEQ ID NO: 1370 - RNA, 19 nt, Artificial Sequence
  Description of Artificial Sequence: Synthetic oligonucleotide
cuugauugaaaaguuggcu

SEQ ID NO: 1371 - RNA, 19 nt, Artificial Sequence
  Description of Artificial Sequence: Synthetic oligonucleotide
gccaacuuuucaaucaaga

SEQ ID NO: 1372 - RNA, 19 nt, Artificial Sequence
  Description of Artificial Sequence: Synthetic oligonucleotide
ucuugauugaaaaguuggc

SEQ ID NO: 1373 - RNA, 19 nt, Artificial Sequence
  Description of Artificial Sequence: Synthetic oligonucleotide
ccaacuuuucaaucaagau

SEQ ID NO: 1374 - RNA, 19 nt, Artificial Sequence
  Description of Artificial Sequence: Synthetic oligonucleotide
aucuugauugaaaaguugg

SEQ ID NO: 1375 - RNA, 19 nt, Artificial Sequence
  Description of Artificial Sequence: Synthetic oligonucleotide
acuuuucaaucaagauacg

SEQ ID NO: 1376 - RNA, 19 nt, Artificial Sequence
  Description of Artificial Sequence: Synthetic oligonucleotide
cguaucuugauugaaaagu

SEQ ID NO: 1377 - RNA, 19 nt, Artificial Sequence
  Description of Artificial Sequence: Synthetic oligonucleotide
cuuuucaaucaagauacga

SEQ ID NO: 1378 - RNA, 19 nt, Artificial Sequence
  Description of Artificial Sequence: Synthetic oligonucleotide
ucguaucuugauugaaaag

SEQ ID NO: 1379 - RNA, 19 nt, Artificial Sequence
  Description of Artificial Sequence: Synthetic oligonucleotide
uuucaaucaagauacgaag

SEQ ID NO: 1380 - RNA, 19 nt, Artificial Sequence
  Description of Artificial Sequence: Synthetic oligonucleotide
cuucguaucuugauugaaa

SEQ ID NO: 1381 - RNA, 19 nt, Artificial Sequence
  Description of Artificial Sequence: Synthetic oligonucleotide
uucaaucaagauacgaaga

SEQ ID NO: 1382 - RNA, 19 nt, Artificial Sequence
  Description of Artificial Sequence: Synthetic oligonucleotide
ucuucguaucuugauugaa

SEQ ID NO: 1383 - RNA, 19 nt, Artificial Sequence
  Description of Artificial Sequence: Synthetic oligonucleotide
ucaaucaagauacgaagag

SEQ ID NO: 1384 - RNA, 19 nt, Artificial Sequence
  Description of Artificial Sequence: Synthetic oligonucleotide
cucuucguaucuugauuga

SEQ ID NO: 1385 - RNA, 19 nt, Artificial Sequence
  Description of Artificial Sequence: Synthetic oligonucleotide
gcaggcauauugcacuauc

SEQ ID NO: 1386 - RNA, 19 nt, Artificial Sequence
  Description of Artificial Sequence: Synthetic oligonucleotide
gauagugcaauaugccugc

SEQ ID NO: 1387 - RNA, 19 nt, Artificial Sequence
  Description of Artificial Sequence: Synthetic oligonucleotide
caggcauauugcacuaucc

SEQ ID NO: 1388 - RNA, 19 nt, Artificial Sequence
  Description of Artificial Sequence: Synthetic oligonucleotide
ggauagugcaauaugccug

SEQ ID NO: 1389 - RNA, 19 nt, Artificial Sequence
  Description of Artificial Sequence: Synthetic oligonucleotide
cuugaaggaggucuuuugg

SEQ ID NO: 1390 - RNA, 19 nt, Artificial Sequence
  Description of Artificial Sequence: Synthetic oligonucleotide
ccaaaagaccuccuucaag

SEQ ID NO: 1391 - RNA, 19 nt, Artificial Sequence
  Description of Artificial Sequence: Synthetic oligonucleotide
uugaaggaggucuuuugga

SEQ ID NO: 1392 - RNA, 19 nt, Artificial Sequence
  Description of Artificial Sequence: Synthetic oligonucleotide
uccaaaagaccuccuucaa

SEQ ID NO: 1393 - RNA, 19 nt, Artificial Sequence
  Description of Artificial Sequence: Synthetic oligonucleotide
gaaggaggucuuuuggaag

SEQ ID NO: 1394 - RNA, 19 nt, Artificial Sequence
  Description of Artificial Sequence: Synthetic oligonucleotide
cuuccaaaagaccuccuuc

SEQ ID NO: 1395 - RNA, 19 nt, Artificial Sequence
  Description of Artificial Sequence: Synthetic oligonucleotide
uuuggaagaucacuuugaa

SEQ ID NO: 1396 - RNA, 19 nt, Artificial Sequence
  Description of Artificial Sequence: Synthetic oligonucleotide
uucaaagugaucuuccaaa

SEQ ID NO: 1397 - RNA, 19 nt, Artificial Sequence
  Description of Artificial Sequence: Synthetic oligonucleotide
aaaaugaguacauaccuug

SEQ ID NO: 1398 - RNA, 19 nt, Artificial Sequence
  Description of Artificial Sequence: Synthetic oligonucleotide
caagguauguacucauuuu

SEQ ID NO: 1399 - RNA, 19 nt, Artificial Sequence
  Description of Artificial Sequence: Synthetic oligonucleotide
aaaugaguacauaccuugu

SEQ ID NO: 1400 - RNA, 19 nt, Artificial Sequence
  Description of Artificial Sequence: Synthetic oligonucleotide
acaagguauguacucauuu

SEQ ID NO: 1401 - RNA, 19 nt, Artificial Sequence
  Description of Artificial Sequence: Synthetic oligonucleotide
guagccuacauaguuugug

SEQ ID NO: 1402 - RNA, 19 nt, Artificial Sequence
  Description of Artificial Sequence: Synthetic oligonucleotide
cacaaacuauguaggcuac

SEQ ID NO: 1403 - RNA, 19 nt, Artificial Sequence
  Description of Artificial Sequence: Synthetic oligonucleotide
auaguuugugauuuccacu

SEQ ID NO: 1404 - RNA, 19 nt, Artificial Sequence
  Description of Artificial Sequence: Synthetic oligonucleotide
aguggaaaucacaaacuau

SEQ ID NO: 1405 - RNA, 19 nt, Artificial Sequence
  Description of Artificial Sequence: Synthetic oligonucleotide
uaguuugugauuuccacuc

SEQ ID NO: 1406 - RNA, 19 nt, Artificial Sequence
  Description of Artificial Sequence: Synthetic oligonucleotide
gaguggaaaucacaaacua

SEQ ID NO: 1407 - RNA, 19 nt, Artificial Sequence
  Description of Artificial Sequence: Synthetic oligonucleotide
aguuugugauuuccacucu

SEQ ID NO: 1408 - RNA, 19 nt, Artificial Sequence
  Description of Artificial Sequence: Synthetic oligonucleotide
agaguggaaaucacaaacu

SEQ ID NO: 1409 - RNA, 19 nt, Artificial Sequence
  Description of Artificial Sequence: Synthetic oligonucleotide
guuugugauuuccacucuc

SEQ ID NO: 1410 - RNA, 19 nt, Artificial Sequence
  Description of Artificial Sequence: Synthetic oligonucleotide
gagaguggaaaucacaaac

SEQ ID NO: 1411 - RNA, 19 nt, Artificial Sequence
  Description of Artificial Sequence: Synthetic oligonucleotide
uuugugauuuccacucucu

SEQ ID NO: 1412 - RNA, 19 nt, Artificial Sequence
  Description of Artificial Sequence: Synthetic oligonucleotide
agagaguggaaaucacaaa

SEQ ID NO: 1413 - RNA, 19 nt, Artificial Sequence
  Description of Artificial Sequence: Synthetic oligonucleotide
uugugauuuccacucucug

SEQ ID NO: 1414 - RNA, 19 nt, Artificial Sequence
  Description of Artificial Sequence: Synthetic oligonucleotide
cagagaguggaaaucacaa

SEQ ID NO: 1415 - RNA, 19 nt, Artificial Sequence
  Description of Artificial Sequence: Synthetic oligonucleotide
ugugauuuccacucucuga

SEQ ID NO: 1416 - RNA, 19 nt, Artificial Sequence
  Description of Artificial Sequence: Synthetic oligonucleotide
ucagagaguggaaaucaca

SEQ ID NO: 1417 - RNA, 19 nt, Artificial Sequence
  Description of Artificial Sequence: Synthetic oligonucleotide
gugauuuccacucucugag

SEQ ID NO: 1418 - RNA, 19 nt, Artificial Sequence
  Description of Artificial Sequence: Synthetic oligonucleotide
cucagagaguggaaaucac

SEQ ID NO: 1419 - RNA, 19 nt, Artificial Sequence
  Description of Artificial Sequence: Synthetic oligonucleotide
gggucaagguguccaucua

SEQ ID NO: 1420 - RNA, 19 nt, Artificial Sequence
  Description of Artificial Sequence: Synthetic oligonucleotide
uagauggacaccuugaccc

SEQ ID NO: 1421 - RNA, 19 nt, Artificial Sequence
  Description of Artificial Sequence: Synthetic oligonucleotide
ggucaagguguccaucuau

SEQ ID NO: 1422 - RNA, 19 nt, Artificial Sequence
  Description of Artificial Sequence: Synthetic oligonucleotide
auagauggacaccuugacc

SEQ ID NO: 1423 - RNA, 19 nt, Artificial Sequence
  Description of Artificial Sequence: Synthetic oligonucleotide
gucaagguguccaucuaug

SEQ ID NO: 1424 - RNA, 19 nt, Artificial Sequence
  Description of Artificial Sequence: Synthetic oligonucleotide
cauagauggacaccuugac

SEQ ID NO: 1425 - RNA, 19 nt, Artificial Sequence
  Description of Artificial Sequence: Synthetic oligonucleotide
ucaagguguccaucuaugc

SEQ ID NO: 1426 - RNA, 19 nt, Artificial Sequence
  Description of Artificial Sequence: Synthetic oligonucleotide
gcauagauggacaccuuga

SEQ ID NO: 1427 - RNA, 19 nt, Artificial Sequence
  Description of Artificial Sequence: Synthetic oligonucleotide
ugcuuugcaggcaucacug

SEQ ID NO: 1428 - RNA, 19 nt, Artificial Sequence
  Description of Artificial Sequence: Synthetic oligonucleotide
cagugaugccugcaaagca

SEQ ID NO: 1429 - RNA, 19 nt, Artificial Sequence
  Description of Artificial Sequence: Synthetic oligonucleotide
gcuuugcaggcaucacuga

SEQ ID NO: 1430 - RNA, 19 nt, Artificial Sequence
  Description of Artificial Sequence: Synthetic oligonucleotide
ucagugaugccugcaaagc

SEQ ID NO: 1431 - RNA, 19 nt, Artificial Sequence
  Description of Artificial Sequence: Synthetic oligonucleotide
cuuugcaggcaucacugaa

SEQ ID NO: 1432 - RNA, 19 nt, Artificial Sequence
  Description of Artificial Sequence: Synthetic oligonucleotide
uucagugaugccugcaaag

SEQ ID NO: 1433 - RNA, 19 nt, Artificial Sequence
  Description of Artificial Sequence: Synthetic oligonucleotide
uuugcaggcaucacugaag

SEQ ID NO: 1434 - RNA, 19 nt, Artificial Sequence
  Description of Artificial Sequence: Synthetic oligonucleotide
cuucagugaugccugcaaa

SEQ ID NO: 1435 - RNA, 19 nt, Artificial Sequence
  Description of Artificial Sequence: Synthetic oligonucleotide
uugcaggcaucacugaagc

SEQ ID NO: 1436 - RNA, 19 nt, Artificial Sequence
  Description of Artificial Sequence: Synthetic oligonucleotide
gcuucagugaugccugcaa

SEQ ID NO: 1437 - RNA, 19 nt, Artificial Sequence
  Description of Artificial Sequence: Synthetic oligonucleotide
caggcaucacugaagcuac

SEQ ID NO: 1438 - RNA, 19 nt, Artificial Sequence
  Description of Artificial Sequence: Synthetic oligonucleotide
guagcuucagugaugccug

SEQ ID NO: 1439 - RNA, 19 nt, Artificial Sequence
  Description of Artificial Sequence: Synthetic oligonucleotide
aggcaucacugaagcuacu

SEQ ID NO: 1440 - RNA, 19 nt, Artificial Sequence
  Description of Artificial Sequence: Synthetic oligonucleotide
aguagcuucagugaugccu

SEQ ID NO: 1441 - RNA, 19 nt, Artificial Sequence
  Description of Artificial Sequence: Synthetic oligonucleotide
ggcaucacugaagcuacuu

SEQ ID NO: 1442 - RNA, 19 nt, Artificial Sequence
  Description of Artificial Sequence: Synthetic oligonucleotide
aaguagcuucagugaugcc

SEQ ID NO: 1443 - RNA, 19 nt, Artificial Sequence
  Description of Artificial Sequence: Synthetic oligonucleotide
auaucuacuauccacucuc

SEQ ID NO: 1444 - RNA, 19 nt, Artificial Sequence
  Description of Artificial Sequence: Synthetic oligonucleotide
gagaguggauaguagauau

SEQ ID NO: 1445 - RNA, 19 nt, Artificial Sequence
  Description of Artificial Sequence: Synthetic oligonucleotide
cuacuauccacucuccaaa

SEQ ID NO: 1446 - RNA, 19 nt, Artificial Sequence
  Description of Artificial Sequence: Synthetic oligonucleotide
uuuggagaguggauaguag

SEQ ID NO: 1447 - RNA, 19 nt, Artificial Sequence
  Description of Artificial Sequence: Synthetic oligonucleotide
cuggauuuaauugcuauuc

SEQ ID NO: 1448 - RNA, 19 nt, Artificial Sequence
  Description of Artificial Sequence: Synthetic oligonucleotide
gaauagcaauuaaauccag

SEQ ID NO: 1449 - RNA, 19 nt, Artificial Sequence
  Description of Artificial Sequence: Synthetic oligonucleotide
uggauuuaauugcuauucc

SEQ ID NO: 1450 - RNA, 19 nt, Artificial Sequence
  Description of Artificial Sequence: Synthetic oligonucleotide
ggaauagcaauuaaaucca

SEQ ID NO: 1451 - RNA, 19 nt, Artificial Sequence
  Description of Artificial Sequence: Synthetic oligonucleotide
ggauuuaauugcuauuccu

SEQ ID NO: 1452 - RNA, 19 nt, Artificial Sequence
  Description of Artificial Sequence: Synthetic oligonucleotide
aggaauagcaauuaaaucc

SEQ ID NO: 1453 - RNA, 19 nt, Artificial Sequence
  Description of Artificial Sequence: Synthetic oligonucleotide
uuaauugcuauuccugacu

SEQ ID NO: 1454 - RNA, 19 nt, Artificial Sequence
  Description of Artificial Sequence: Synthetic oligonucleotide
agucaggaauagcaauuaa

SEQ ID NO: 1455 - RNA, 19 nt, Artificial Sequence
  Description of Artificial Sequence: Synthetic oligonucleotide
uaauugcuauuccugacuu

SEQ ID NO: 1456 - RNA, 19 nt, Artificial Sequence
  Description of Artificial Sequence: Synthetic oligonucleotide
aagucaggaauagcaauua

SEQ ID NO: 1457 - RNA, 19 nt, Artificial Sequence
  Description of Artificial Sequence: Synthetic oligonucleotide
aauugcuauuccugacuuu

SEQ ID NO: 1458 - RNA, 19 nt, Artificial Sequence
  Description of Artificial Sequence: Synthetic oligonucleotide
aaagucaggaauagcaauu

SEQ ID NO: 1459 - RNA, 19 nt, Artificial Sequence
  Description of Artificial Sequence: Synthetic oligonucleotide
auugcuauuccugacuuug

SEQ ID NO: 1460 - RNA, 19 nt, Artificial Sequence
  Description of Artificial Sequence: Synthetic oligonucleotide
caaagucaggaauagcaau

SEQ ID NO: 1461 - RNA, 19 nt, Artificial Sequence
  Description of Artificial Sequence: Synthetic oligonucleotide
uugcuauuccugacuuugc

SEQ ID NO: 1462 - RNA, 19 nt, Artificial Sequence
  Description of Artificial Sequence: Synthetic oligonucleotide
gcaaagucaggaauagcaa

SEQ ID NO: 1463 - RNA, 19 nt, Artificial Sequence
  Description of Artificial Sequence: Synthetic oligonucleotide
ugcuauuccugacuuugca

SEQ ID NO: 1464 - RNA, 19 nt, Artificial Sequence
  Description of Artificial Sequence: Synthetic oligonucleotide
ugcaaagucaggaauagca

SEQ ID NO: 1465 - RNA, 19 nt, Artificial Sequence
  Description of Artificial Sequence: Synthetic oligonucleotide
ccugacuuugcaccuggag

SEQ ID NO: 1466 - RNA, 19 nt, Artificial Sequence
  Description of Artificial Sequence: Synthetic oligonucleotide
cuccaggugcaaagucagg

SEQ ID NO: 1467 - RNA, 19 nt, Artificial Sequence
  Description of Artificial Sequence: Synthetic oligonucleotide
cugacuuugcaccuggagc

SEQ ID NO: 1468 - RNA, 19 nt, Artificial Sequence
  Description of Artificial Sequence: Synthetic oligonucleotide
gcuccaggugcaaagucag

SEQ ID NO: 1469 - RNA, 19 nt, Artificial Sequence
  Description of Artificial Sequence: Synthetic oligonucleotide
gacuuugcaccuggagcca

SEQ ID NO: 1470 - RNA, 19 nt, Artificial Sequence
  Description of Artificial Sequence: Synthetic oligonucleotide
uggcuccaggugcaaaguc

SEQ ID NO: 1471 - RNA, 19 nt, Artificial Sequence
  Description of Artificial Sequence: Synthetic oligonucleotide
uugcaccuggagccaugga

SEQ ID NO: 1472 - RNA, 19 nt, Artificial Sequence
  Description of Artificial Sequence: Synthetic oligonucleotide
uccauggcuccaggugcaa

SEQ ID NO: 1473 - RNA, 19 nt, Artificial Sequence
  Description of Artificial Sequence: Synthetic oligonucleotide
ugcaccuggagccauggaa

SEQ ID NO: 1474 - RNA, 19 nt, Artificial Sequence
  Description of Artificial Sequence: Synthetic oligonucleotide
uuccauggcuccaggugca

SEQ ID NO: 1475 - RNA, 19 nt, Artificial Sequence
  Description of Artificial Sequence: Synthetic oligonucleotide
gggccucauuacauauagg

SEQ ID NO: 1476 - RNA, 19 nt, Artificial Sequence
  Description of Artificial Sequence: Synthetic oligonucleotide
ccuauauguaaugaggccc

SEQ ID NO: 1477 - RNA, 19 nt, Artificial Sequence
  Description of Artificial Sequence: Synthetic oligonucleotide
ggccucauuacauauaggg

SEQ ID NO: 1478 - RNA, 19 nt, Artificial Sequence
  Description of Artificial Sequence: Synthetic oligonucleotide
cccuauauguaaugaggcc

SEQ ID NO: 1479 - RNA, 19 nt, Artificial Sequence
  Description of Artificial Sequence: Synthetic oligonucleotide
gccucauuacauauaggga

SEQ ID NO: 1480 - RNA, 19 nt, Artificial Sequence
  Description of Artificial Sequence: Synthetic oligonucleotide
ucccuauauguaaugaggc

SEQ ID NO: 1481 - RNA, 19 nt, Artificial Sequence
  Description of Artificial Sequence: Synthetic oligonucleotide
ccaagaccucuucugcuuc

SEQ ID NO: 1482 - RNA, 19 nt, Artificial Sequence
  Description of Artificial Sequence: Synthetic oligonucleotide
gaagcagaagaggucuugg

SEQ ID NO: 1483 - RNA, 19 nt, Artificial Sequence
  Description of Artificial Sequence: Synthetic oligonucleotide
caagaccucuucugcuucc

SEQ ID NO: 1484 - RNA, 19 nt, Artificial Sequence
  Description of Artificial Sequence: Synthetic oligonucleotide
ggaagcagaagaggucuug

SEQ ID NO: 1485 - RNA, 19 nt, Artificial Sequence
  Description of Artificial Sequence: Synthetic oligonucleotide
aagaccucuucugcuuccg

SEQ ID NO: 1486 - RNA, 19 nt, Artificial Sequence
  Description of Artificial Sequence: Synthetic oligonucleotide
cggaagcagaagaggucuu

SEQ ID NO: 1487 - RNA, 19 nt, Artificial Sequence
  Description of Artificial Sequence: Synthetic oligonucleotide
agaccucuucugcuuccga

SEQ ID NO: 1488 - RNA, 19 nt, Artificial Sequence
  Description of Artificial Sequence: Synthetic oligonucleotide
ucggaagcagaagaggucu

SEQ ID NO: 1489 - RNA, 19 nt, Artificial Sequence
  Description of Artificial Sequence: Synthetic oligonucleotide
gaccucuucugcuuccgau

SEQ ID NO: 1490 - RNA, 19 nt, Artificial Sequence
  Description of Artificial Sequence: Synthetic oligonucleotide
aucggaagcagaagagguc

SEQ ID NO: 1491 - RNA, 19 nt, Artificial Sequence
  Description of Artificial Sequence: Synthetic oligonucleotide
accucuucugcuuccgaua

SEQ ID NO: 1492 - RNA, 19 nt, Artificial Sequence
  Description of Artificial Sequence: Synthetic oligonucleotide
uaucggaagcagaagaggu

SEQ ID NO: 1493 - RNA, 19 nt, Artificial Sequence
  Description of Artificial Sequence: Synthetic oligonucleotide
ccucuucugcuuccgauaa

SEQ ID NO: 1494 - RNA, 19 nt, Artificial Sequence
  Description of Artificial Sequence: Synthetic oligonucleotide
uuaucggaagcagaagagg

SEQ ID NO: 1495 - RNA, 19 nt, Artificial Sequence
  Description of Artificial Sequence: Synthetic oligonucleotide
cucuucugcuuccgauaaa

SEQ ID NO: 1496 - RNA, 19 nt, Artificial Sequence
  Description of Artificial Sequence: Synthetic oligonucleotide
uuuaucggaagcagaagag

SEQ ID NO: 1497 - RNA, 19 nt, Artificial Sequence
  Description of Artificial Sequence: Synthetic oligonucleotide
cugugggucaccagaguca

SEQ ID NO: 1498 - RNA, 19 nt, Artificial Sequence
  Description of Artificial Sequence: Synthetic oligonucleotide
ugacucuggugacccacag

SEQ ID NO: 1499 - RNA, 19 nt, Artificial Sequence
  Description of Artificial Sequence: Synthetic oligonucleotide
ugugggucaccagagucau

SEQ ID NO: 1500 - RNA, 19 nt, Artificial Sequence
  Description of Artificial Sequence: Synthetic oligonucleotide
augacucuggugacccaca

SEQ ID NO: 1501 - RNA, 19 nt, Artificial Sequence
  Description of Artificial Sequence: Synthetic oligonucleotide
gugggucaccagagucaua

SEQ ID NO: 1502 - RNA, 19 nt, Artificial Sequence
  Description of Artificial Sequence: Synthetic oligonucleotide
uaugacucuggugacccac

SEQ ID NO: 1503 - RNA, 19 nt, Artificial Sequence
  Description of Artificial Sequence: Synthetic oligonucleotide
ugggucaccagagucauag

SEQ ID NO: 1504 - RNA, 19 nt, Artificial Sequence
  Description of Artificial Sequence: Synthetic oligonucleotide
cuaugacucuggugaccca

SEQ ID NO: 1505 - RNA, 19 nt, Artificial Sequence
  Description of Artificial Sequence: Synthetic oligonucleotide
ucaccagagucauagccca

SEQ ID NO: 1506 - RNA, 19 nt, Artificial Sequence
  Description of Artificial Sequence: Synthetic oligonucleotide
ugggcuaugacucugguga

SEQ ID NO: 1507 - RNA, 19 nt, Artificial Sequence
  Description of Artificial Sequence: Synthetic oligonucleotide
accagagucauagcccaug

SEQ ID NO: 1508 - RNA, 19 nt, Artificial Sequence
  Description of Artificial Sequence: Synthetic oligonucleotide
caugggcuaugacucuggu

SEQ ID NO: 1509 - RNA, 19 nt, Artificial Sequence
  Description of Artificial Sequence: Synthetic oligonucleotide
gcgcaccagugguuuggca

SEQ ID NO: 1510 - RNA, 19 nt, Artificial Sequence
  Description of Artificial Sequence: Synthetic oligonucleotide
ugccaaaccacuggugcgc

SEQ ID NO: 1511 - RNA, 19 nt, Artificial Sequence
  Description of Artificial Sequence: Synthetic oligonucleotide
cgcaccagugguuuggcaa

SEQ ID NO: 1512 - RNA, 19 nt, Artificial Sequence
  Description of Artificial Sequence: Synthetic oligonucleotide
uugccaaaccacuggugcg

SEQ ID NO: 1513 - RNA, 19 nt, Artificial Sequence
  Description of Artificial Sequence: Synthetic oligonucleotide
gcaccagugguuuggcaac

SEQ ID NO: 1514 - RNA, 19 nt, Artificial Sequence
  Description of Artificial Sequence: Synthetic oligonucleotide
guugccaaaccacuggugc

SEQ ID NO: 1515 - RNA, 19 nt, Artificial Sequence
  Description of Artificial Sequence: Synthetic oligonucleotide
guuuggcaaccuggucaca

SEQ ID NO: 1516 - RNA, 19 nt, Artificial Sequence
  Description of Artificial Sequence: Synthetic oligonucleotide
ugugaccagguugccaaac

SEQ ID NO: 1517 - RNA, 19 nt, Artificial Sequence
  Description of Artificial Sequence: Synthetic oligonucleotide
aaugguggaaugauauuug

SEQ ID NO: 1518 - RNA, 19 nt, Artificial Sequence
  Description of Artificial Sequence: Synthetic oligonucleotide
caaauaucauuccaccauu

SEQ ID NO: 1519 - RNA, 19 nt, Artificial Sequence
  Description of Artificial Sequence: Synthetic oligonucleotide
augguggaaugauauuugg

SEQ ID NO: 1520 - RNA, 19 nt, Artificial Sequence
  Description of Artificial Sequence: Synthetic oligonucleotide
ccaaauaucauuccaccau

SEQ ID NO: 1521 - RNA, 19 nt, Artificial Sequence
  Description of Artificial Sequence: Synthetic oligonucleotide
ugguggaaugauauuuggc

SEQ ID NO: 1522 - RNA, 19 nt, Artificial Sequence
  Description of Artificial Sequence: Synthetic oligonucleotide
gccaaauaucauuccacca

SEQ ID NO: 1523 - RNA, 19 nt, Artificial Sequence
  Description of Artificial Sequence: Synthetic oligonucleotide
gguggaaugauauuuggcu

SEQ ID NO: 1524 - RNA, 19 nt, Artificial Sequence
  Description of Artificial Sequence: Synthetic oligonucleotide
agccaaauaucauuccacc

SEQ ID NO: 1525 - RNA, 19 nt, Artificial Sequence
  Description of Artificial Sequence: Synthetic oligonucleotide
guggaaugauauuuggcuu

SEQ ID NO: 1526 - RNA, 19 nt, Artificial Sequence
  Description of Artificial Sequence: Synthetic oligonucleotide
aagccaaauaucauuccac

SEQ ID NO: 1527 - RNA, 19 nt, Artificial Sequence
  Description of Artificial Sequence: Synthetic oligonucleotide
uggaaugauauuuggcuua

SEQ ID NO: 1528 - RNA, 19 nt, Artificial Sequence
  Description of Artificial Sequence: Synthetic oligonucleotide
uaagccaaauaucauucca

SEQ ID NO: 1529 - RNA, 19 nt, Artificial Sequence
  Description of Artificial Sequence: Synthetic oligonucleotide
ggaaugauauuuggcuuaa

SEQ ID NO: 1530 - RNA, 19 nt, Artificial Sequence
  Description of Artificial Sequence: Synthetic oligonucleotide
uuaagccaaauaucauucc

SEQ ID NO: 1531 - RNA, 19 nt, Artificial Sequence
  Description of Artificial Sequence: Synthetic oligonucleotide
gaggguuuugcaaaauaca

SEQ ID NO: 1532 - RNA, 19 nt, Artificial Sequence
  Description of Artificial Sequence: Synthetic oligonucleotide
uguauuuugcaaaacccuc

SEQ ID NO: 1533 - RNA, 19 nt, Artificial Sequence
  Description of Artificial Sequence: Synthetic oligonucleotide
aggguuuugcaaaauacau

SEQ ID NO: 1534 - RNA, 19 nt, Artificial Sequence
  Description of Artificial Sequence: Synthetic oligonucleotide
auguauuuugcaaaacccu

SEQ ID NO: 1535 - RNA, 19 nt, Artificial Sequence
  Description of Artificial Sequence: Synthetic oligonucleotide
ggguuuugcaaaauacaug

SEQ ID NO: 1536 - RNA, 19 nt, Artificial Sequence
  Description of Artificial Sequence: Synthetic oligonucleotide
cauguauuuugcaaaaccc

SEQ ID NO: 1537 - RNA, 19 nt, Artificial Sequence
  Description of Artificial Sequence: Synthetic oligonucleotide
gguuuugcaaaauacaugg

SEQ ID NO: 1538 - RNA, 19 nt, Artificial Sequence
  Description of Artificial Sequence: Synthetic oligonucleotide
ccauguauuuugcaaaacc

SEQ ID NO: 1539 - RNA, 19 nt, Artificial Sequence
  Description of Artificial Sequence: Synthetic oligonucleotide
guuuugcaaaauacaugga

SEQ ID NO: 1540 - RNA, 19 nt, Artificial Sequence
  Description of Artificial Sequence: Synthetic oligonucleotide
uccauguauuuugcaaaac

SEQ ID NO: 1541 - RNA, 19 nt, Artificial Sequence
  Description of Artificial Sequence: Synthetic oligonucleotide
aacuuaucgcuguuaaugc

SEQ ID NO: 1542 - RNA, 19 nt, Artificial Sequence
  Description of Artificial Sequence: Synthetic oligonucleotide
gcauuaacagcgauaaguu

SEQ ID NO: 1543 - RNA, 19 nt, Artificial Sequence
  Description of Artificial Sequence: Synthetic oligonucleotide
acuuaucgcuguuaaugcu

SEQ ID NO: 1544 - RNA, 19 nt, Artificial Sequence
  Description of Artificial Sequence: Synthetic oligonucleotide
agcauuaacagcgauaagu

SEQ ID NO: 1545 - RNA, 19 nt, Artificial Sequence
  Description of Artificial Sequence: Synthetic oligonucleotide
cuuaucgcuguuaaugcua

SEQ ID NO: 1546 - RNA, 19 nt, Artificial Sequence
  Description of Artificial Sequence: Synthetic oligonucleotide
uagcauuaacagcgauaag

SEQ ID NO: 1547 - RNA, 19 nt, Artificial Sequence
  Description of Artificial Sequence: Synthetic oligonucleotide
uuaucgcuguuaaugcuac

SEQ ID NO: 1548 - RNA, 19 nt, Artificial Sequence
  Description of Artificial Sequence: Synthetic oligonucleotide
guagcauuaacagcgauaa

SEQ ID NO: 1549 - RNA, 19 nt, Artificial Sequence
  Description of Artificial Sequence: Synthetic oligonucleotide
uaucgcuguuaaugcuaca

SEQ ID NO: 1550 - RNA, 19 nt, Artificial Sequence
  Description of Artificial Sequence: Synthetic oligonucleotide
uguagcauuaacagcgaua

SEQ ID NO: 1551 - RNA, 19 nt, Artificial Sequence
  Description of Artificial Sequence: Synthetic oligonucleotide
uugaauguguguuuugaag

SEQ ID NO: 1552 - RNA, 19 nt, Artificial Sequence
  Description of Artificial Sequence: Synthetic oligonucleotide
cuucaaaacacacauucaa

SEQ ID NO: 1553 - RNA, 19 nt, Artificial Sequence
  Description of Artificial Sequence: Synthetic oligonucleotide
ugaauguguguuuugaagu

SEQ ID NO: 1554 - RNA, 19 nt, Artificial Sequence
  Description of Artificial Sequence: Synthetic oligonucleotide
acuucaaaacacacauuca

SEQ ID NO: 1555 - RNA, 19 nt, Artificial Sequence
  Description of Artificial Sequence: Synthetic oligonucleotide
gaauguguguuuugaagua

SEQ ID NO: 1556 - RNA, 19 nt, Artificial Sequence
  Description of Artificial Sequence: Synthetic oligonucleotide
uacuucaaaacacacauuc

SEQ ID NO: 1557 - RNA, 19 nt, Artificial Sequence
  Description of Artificial Sequence: Synthetic oligonucleotide
uucauugaauucaucccgc

SEQ ID NO: 1558 - RNA, 19 nt, Artificial Sequence
  Description of Artificial Sequence: Synthetic oligonucleotide
gcgggaugaauucaaugaa

SEQ ID NO: 1559 - RNA, 19 nt, Artificial Sequence
  Description of Artificial Sequence: Synthetic oligonucleotide
aauguuugaugaaguuucc

SEQ ID NO: 1560 - RNA, 19 nt, Artificial Sequence
  Description of Artificial Sequence: Synthetic oligonucleotide
ggaaacuucaucaaacauu

SEQ ID NO: 1561 - RNA, 19 nt, Artificial Sequence
  Description of Artificial Sequence: Synthetic oligonucleotide
aagggagcuuguauuuuga

SEQ ID NO: 1562 - RNA, 19 nt, Artificial Sequence
  Description of Artificial Sequence: Synthetic oligonucleotide
ucaaaauacaagcucccuu

SEQ ID NO: 1563 - RNA, 19 nt, Artificial Sequence
  Description of Artificial Sequence: Synthetic oligonucleotide
gggagcuuguauuuugaau

SEQ ID NO: 1564 - RNA, 19 nt, Artificial Sequence
  Description of Artificial Sequence: Synthetic oligonucleotide
auucaaaauacaagcuccc

SEQ ID NO: 1565 - RNA, 19 nt, Artificial Sequence
  Description of Artificial Sequence: Synthetic oligonucleotide
gaauaugcucaaggauuuu

SEQ ID NO: 1566 - RNA, 19 nt, Artificial Sequence
  Description of Artificial Sequence: Synthetic oligonucleotide
aaaauccuugagcauauuc

SEQ ID NO: 1567 - RNA, 19 nt, Artificial Sequence
  Description of Artificial Sequence: Synthetic oligonucleotide
aauaugcucaaggauuuuc

SEQ ID NO: 1568 - RNA, 19 nt, Artificial Sequence
  Description of Artificial Sequence: Synthetic oligonucleotide
gaaaauccuugagcauauu

SEQ ID NO: 1569 - RNA, 19 nt, Artificial Sequence
  Description of Artificial Sequence: Synthetic oligonucleotide
auaugcucaaggauuuucu

SEQ ID NO: 1570 - RNA, 19 nt, Artificial Sequence
  Description of Artificial Sequence: Synthetic oligonucleotide
agaaaauccuugagcauau

SEQ ID NO: 1571 - RNA, 19 nt, Artificial Sequence
  Description of Artificial Sequence: Synthetic oligonucleotide
uaugcucaaggauuuucug

SEQ ID NO: 1572 - RNA, 19 nt, Artificial Sequence
  Description of Artificial Sequence: Synthetic oligonucleotide
cagaaaauccuugagcaua

SEQ ID NO: 1573 - RNA, 19 nt, Artificial Sequence
  Description of Artificial Sequence: Synthetic oligonucleotide
augcucaaggauuuucugg

SEQ ID NO: 1574 - RNA, 19 nt, Artificial Sequence
  Description of Artificial Sequence: Synthetic oligonucleotide
ccagaaaauccuugagcau

SEQ ID NO: 1575 - RNA, 19 nt, Artificial Sequence
  Description of Artificial Sequence: Synthetic oligonucleotide
gcucaaggauuuucugggu

SEQ ID NO: 1576 - RNA, 19 nt, Artificial Sequence
  Description of Artificial Sequence: Synthetic oligonucleotide
acccagaaaauccuugagc

SEQ ID NO: 1577 - RNA, 19 nt, Artificial Sequence
  Description of Artificial Sequence: Synthetic oligonucleotide
cucaaggauuuucugggug

SEQ ID NO: 1578 - RNA, 19 nt, Artificial Sequence
  Description of Artificial Sequence: Synthetic oligonucleotide
cacccagaaaauccuugag

SEQ ID NO: 1579 - RNA, 19 nt, Artificial Sequence
  Description of Artificial Sequence: Synthetic oligonucleotide
ucaaggauuuucuggguga

SEQ ID NO: 1580 - RNA, 19 nt, Artificial Sequence
  Description of Artificial Sequence: Synthetic oligonucleotide
ucacccagaaaauccuuga

SEQ ID NO: 1581 - RNA, 19 nt, Artificial Sequence
  Description of Artificial Sequence: Synthetic oligonucleotide
caaggauuuucugggugag

SEQ ID NO: 1582 - RNA, 19 nt, Artificial Sequence
  Description of Artificial Sequence: Synthetic oligonucleotide
cucacccagaaaauccuug

SEQ ID NO: 1583 - RNA, 19 nt, Artificial Sequence
  Description of Artificial Sequence: Synthetic oligonucleotide
aaggauuuucugggugagg

SEQ ID NO: 1584 - RNA, 19 nt, Artificial Sequence
  Description of Artificial Sequence: Synthetic oligonucleotide
ccucacccagaaaauccuu

SEQ ID NO: 1585 - RNA, 19 nt, Artificial Sequence
  Description of Artificial Sequence: Synthetic oligonucleotide
aggauuuucugggugagga

SEQ ID NO: 1586 - RNA, 19 nt, Artificial Sequence
  Description of Artificial Sequence: Synthetic oligonucleotide
uccucacccagaaaauccu

SEQ ID NO: 1587 - RNA, 19 nt, Artificial Sequence
  Description of Artificial Sequence: Synthetic oligonucleotide
ggauuuucugggugaggag

SEQ ID NO: 1588 - RNA, 19 nt, Artificial Sequence
  Description of Artificial Sequence: Synthetic oligonucleotide
cuccucacccagaaaaucc

SEQ ID NO: 1589 - RNA, 19 nt, Artificial Sequence
  Description of Artificial Sequence: Synthetic oligonucleotide
uaaagaaguucagcuauag

SEQ ID NO: 1590 - RNA, 19 nt, Artificial Sequence
  Description of Artificial Sequence: Synthetic oligonucleotide
cuauagcugaacuucuuua

SEQ ID NO: 1591 - RNA, 19 nt, Artificial Sequence
  Description of Artificial Sequence: Synthetic oligonucleotide
aaagaaguucagcuauaga

SEQ ID NO: 1592 - RNA, 19 nt, Artificial Sequence
  Description of Artificial Sequence: Synthetic oligonucleotide
ucuauagcugaacuucuuu

SEQ ID NO: 1593 - RNA, 19 nt, Artificial Sequence
  Description of Artificial Sequence: Synthetic oligonucleotide
aagaaguucagcuauagaa

SEQ ID NO: 1594 - RNA, 19 nt, Artificial Sequence
  Description of Artificial Sequence: Synthetic oligonucleotide
uucuauagcugaacuucuu

SEQ ID NO: 1595 - RNA, 19 nt, Artificial Sequence
  Description of Artificial Sequence: Synthetic oligonucleotide
aaaugcuaagaaugaugac

SEQ ID NO: 1596 - RNA, 19 nt, Artificial Sequence
  Description of Artificial Sequence: Synthetic oligonucleotide
gucaucauucuuagcauuu

SEQ ID NO: 1597 - RNA, 19 nt, Artificial Sequence
  Description of Artificial Sequence: Synthetic oligonucleotide
aaugcuaagaaugaugacu

SEQ ID NO: 1598 - RNA, 19 nt, Artificial Sequence
  Description of Artificial Sequence: Synthetic oligonucleotide
agucaucauucuuagcauu

SEQ ID NO: 1599 - RNA, 19 nt, Artificial Sequence
  Description of Artificial Sequence: Synthetic oligonucleotide
aagaaugaugacuugugga

SEQ ID NO: 1600 - RNA, 19 nt, Artificial Sequence
  Description of Artificial Sequence: Synthetic oligonucleotide
uccacaagucaucauucuu

SEQ ID NO: 1601 - RNA, 19 nt, Artificial Sequence
  Description of Artificial Sequence: Synthetic oligonucleotide
agaaugaugacuuguggag

SEQ ID NO: 1602 - RNA, 19 nt, Artificial Sequence
  Description of Artificial Sequence: Synthetic oligonucleotide
cuccacaagucaucauucu

SEQ ID NO: 1603 - RNA, 19 nt, Artificial Sequence
  Description of Artificial Sequence: Synthetic oligonucleotide
aaugaugacuuguggagca

SEQ ID NO: 1604 - RNA, 19 nt, Artificial Sequence
  Description of Artificial Sequence: Synthetic oligonucleotide
ugcuccacaagucaucauu

SEQ ID NO: 1605 - RNA, 19 nt, Artificial Sequence
  Description of Artificial Sequence: Synthetic oligonucleotide
augaugacuuguggagcag

SEQ ID NO: 1606 - RNA, 19 nt, Artificial Sequence
  Description of Artificial Sequence: Synthetic oligonucleotide
cugcuccacaagucaucau

SEQ ID NO: 1607 - RNA, 19 nt, Artificial Sequence
  Description of Artificial Sequence: Synthetic oligonucleotide
ugaugacuuguggagcagu

SEQ ID NO: 1608 - RNA, 19 nt, Artificial Sequence
  Description of Artificial Sequence: Synthetic oligonucleotide
acugcuccacaagucauca

SEQ ID NO: 1609 - RNA, 19 nt, Artificial Sequence
  Description of Artificial Sequence: Synthetic oligonucleotide
acuuguggagcagucuguc

SEQ ID NO: 1610 - RNA, 19 nt, Artificial Sequence
  Description of Artificial Sequence: Synthetic oligonucleotide
gacagacugcuccacaagu

SEQ ID NO: 1611 - RNA, 19 nt, Artificial Sequence
  Description of Artificial Sequence: Synthetic oligonucleotide
cuuguggagcagucuguca

SEQ ID NO: 1612 - RNA, 19 nt, Artificial Sequence
  Description of Artificial Sequence: Synthetic oligonucleotide
ugacagacugcuccacaag

SEQ ID NO: 1613 - RNA, 19 nt, Artificial Sequence
  Description of Artificial Sequence: Synthetic oligonucleotide
uuguggagcagucugucaa

SEQ ID NO: 1614 - RNA, 19 nt, Artificial Sequence
  Description of Artificial Sequence: Synthetic oligonucleotide
uugacagacugcuccacaa

SEQ ID NO: 1615 - RNA, 19 nt, Artificial Sequence
  Description of Artificial Sequence: Synthetic oligonucleotide
uguggagcagucugucaaa

SEQ ID NO: 1616 - RNA, 19 nt, Artificial Sequence
  Description of Artificial Sequence: Synthetic oligonucleotide
uuugacagacugcuccaca

SEQ ID NO: 1617 - RNA, 19 nt, Artificial Sequence
  Description of Artificial Sequence: Synthetic oligonucleotide
guggagcagucugucaaau

SEQ ID NO: 1618 - RNA, 19 nt, Artificial Sequence
  Description of Artificial Sequence: Synthetic oligonucleotide
auuugacagacugcuccac

SEQ ID NO: 1619 - RNA, 19 nt, Artificial Sequence
  Description of Artificial Sequence: Synthetic oligonucleotide
uggagcagucugucaaaua

SEQ ID NO: 1620 - RNA, 19 nt, Artificial Sequence
  Description of Artificial Sequence: Synthetic oligonucleotide
uauuugacagacugcucca

SEQ ID NO: 1621 - RNA, 19 nt, Artificial Sequence
  Description of Artificial Sequence: Synthetic oligonucleotide
gcagucugucaaauaguug

SEQ ID NO: 1622 - RNA, 19 nt, Artificial Sequence
  Description of Artificial Sequence: Synthetic oligonucleotide
caacuauuugacagacugc

SEQ ID NO: 1623 - RNA, 19 nt, Artificial Sequence
  Description of Artificial Sequence: Synthetic oligonucleotide
cagucugucaaauaguugu

SEQ ID NO: 1624 - RNA, 19 nt, Artificial Sequence
  Description of Artificial Sequence: Synthetic oligonucleotide
acaacuauuugacagacug

SEQ ID NO: 1625 - RNA, 19 nt, Artificial Sequence
  Description of Artificial Sequence: Synthetic oligonucleotide
agucugucaaauaguuguu

SEQ ID NO: 1626 - RNA, 19 nt, Artificial Sequence
  Description of Artificial Sequence: Synthetic oligonucleotide
aacaacuauuugacagacu

SEQ ID NO: 1627 - RNA, 19 nt, Artificial Sequence
  Description of Artificial Sequence: Synthetic oligonucleotide
gucugucaaauaguuguuu

SEQ ID NO: 1628 - RNA, 19 nt, Artificial Sequence
  Description of Artificial Sequence: Synthetic oligonucleotide
aaacaacuauuugacagac

SEQ ID NO: 1629 - RNA, 19 nt, Artificial Sequence
  Description of Artificial Sequence: Synthetic oligonucleotide
cugucaaauaguuguuuag

SEQ ID NO: 1630 - RNA, 19 nt, Artificial Sequence
  Description of Artificial Sequence: Synthetic oligonucleotide
cuaaacaacuauuugacag

SEQ ID NO: 1631 - RNA, 19 nt, Artificial Sequence
  Description of Artificial Sequence: Synthetic oligonucleotide
gugauuuuacaucuggugg

SEQ ID NO: 1632 - RNA, 19 nt, Artificial Sequence
  Description of Artificial Sequence: Synthetic oligonucleotide
ccaccagauguaaaaucac

SEQ ID NO: 1633 - RNA, 19 nt, Artificial Sequence
  Description of Artificial Sequence: Synthetic oligonucleotide
ugauuuuacaucuggugga

SEQ ID NO: 1634 - RNA, 19 nt, Artificial Sequence
  Description of Artificial Sequence: Synthetic oligonucleotide
uccaccagauguaaaauca

SEQ ID NO: 1635 - RNA, 19 nt, Artificial Sequence
  Description of Artificial Sequence: Synthetic oligonucleotide
gauuuuacaucugguggag

SEQ ID NO: 1636 - RNA, 19 nt, Artificial Sequence
  Description of Artificial Sequence: Synthetic oligonucleotide
cuccaccagauguaaaauc

SEQ ID NO: 1637 - RNA, 19 nt, Artificial Sequence
  Description of Artificial Sequence: Synthetic oligonucleotide
uacaucugguggaguuugu

SEQ ID NO: 1638 - RNA, 19 nt, Artificial Sequence
  Description of Artificial Sequence: Synthetic oligonucleotide
acaaacuccaccagaugua

SEQ ID NO: 1639 - RNA, 19 nt, Artificial Sequence
  Description of Artificial Sequence: Synthetic oligonucleotide
acaucugguggaguuuguc

SEQ ID NO: 1640 - RNA, 19 nt, Artificial Sequence
  Description of Artificial Sequence: Synthetic oligonucleotide
gacaaacuccaccagaugu

SEQ ID NO: 1641 - RNA, 19 nt, Artificial Sequence
  Description of Artificial Sequence: Synthetic oligonucleotide
caucugguggaguuuguca

SEQ ID NO: 1642 - RNA, 19 nt, Artificial Sequence
  Description of Artificial Sequence: Synthetic oligonucleotide
ugacaaacuccaccagaug

SEQ ID NO: 1643 - RNA, 19 nt, Artificial Sequence
  Description of Artificial Sequence: Synthetic oligonucleotide
ugguggaguuugucauucg

SEQ ID NO: 1644 - RNA, 19 nt, Artificial Sequence
  Description of Artificial Sequence: Synthetic oligonucleotide
cgaaugacaaacuccacca

SEQ ID NO: 1645 - RNA, 19 nt, Artificial Sequence
  Description of Artificial Sequence: Synthetic oligonucleotide
gguggaguuugucauucgg

SEQ ID NO: 1646 - RNA, 19 nt, Artificial Sequence
  Description of Artificial Sequence: Synthetic oligonucleotide
ccgaaugacaaacuccacc

SEQ ID NO: 1647 - RNA, 19 nt, Artificial Sequence
  Description of Artificial Sequence: Synthetic oligonucleotide
guggaguuugucauucgga

SEQ ID NO: 1648 - RNA, 19 nt, Artificial Sequence
  Description of Artificial Sequence: Synthetic oligonucleotide
uccgaaugacaaacuccac

SEQ ID NO: 1649 - RNA, 19 nt, Artificial Sequence
  Description of Artificial Sequence: Synthetic oligonucleotide
uggaguuugucauucggau

SEQ ID NO: 1650 - RNA, 19 nt, Artificial Sequence
  Description of Artificial Sequence: Synthetic oligonucleotide
auccgaaugacaaacucca

SEQ ID NO: 1651 - RNA, 19 nt, Artificial Sequence
  Description of Artificial Sequence: Synthetic oligonucleotide
ggaguuugucauucggauc

SEQ ID NO: 1652 - RNA, 19 nt, Artificial Sequence
  Description of Artificial Sequence: Synthetic oligonucleotide
gauccgaaugacaaacucc

SEQ ID NO: 1653 - RNA, 19 nt, Artificial Sequence
  Description of Artificial Sequence: Synthetic oligonucleotide
gaguuugucauucggaucc

SEQ ID NO: 1654 - RNA, 19 nt, Artificial Sequence
  Description of Artificial Sequence: Synthetic oligonucleotide
ggauccgaaugacaaacuc

SEQ ID NO: 1655 - RNA, 19 nt, Artificial Sequence
  Description of Artificial Sequence: Synthetic oligonucleotide
aguuugucauucggauccc

SEQ ID NO: 1656 - RNA, 19 nt, Artificial Sequence
  Description of Artificial Sequence: Synthetic oligonucleotide
gggauccgaaugacaaacu

SEQ ID NO: 1657 - RNA, 19 nt, Artificial Sequence
  Description of Artificial Sequence: Synthetic oligonucleotide
ugucauucggaucccaaga

SEQ ID NO: 1658 - RNA, 19 nt, Artificial Sequence
  Description of Artificial Sequence: Synthetic oligonucleotide
ucuugggauccgaaugaca

SEQ ID NO: 1659 - RNA, 19 nt, Artificial Sequence
  Description of Artificial Sequence: Synthetic oligonucleotide
gucauucggaucccaagau

SEQ ID NO: 1660 - RNA, 19 nt, Artificial Sequence
  Description of Artificial Sequence: Synthetic oligonucleotide
aucuugggauccgaaugac

SEQ ID NO: 1661 - RNA, 19 nt, Artificial Sequence
  Description of Artificial Sequence: Synthetic oligonucleotide
ucauucggaucccaagaug

SEQ ID NO: 1662 - RNA, 19 nt, Artificial Sequence
  Description of Artificial Sequence: Synthetic oligonucleotide
caucuugggauccgaauga

SEQ ID NO: 1663 - RNA, 19 nt, Artificial Sequence
  Description of Artificial Sequence: Synthetic oligonucleotide
cauucggaucccaagauga

SEQ ID NO: 1664 - RNA, 19 nt, Artificial Sequence
  Description of Artificial Sequence: Synthetic oligonucleotide
ucaucuugggauccgaaug

SEQ ID NO: 1665 - RNA, 19 nt, Artificial Sequence
  Description of Artificial Sequence: Synthetic oligonucleotide
auucggaucccaagaugac

SEQ ID NO: 1666 - RNA, 19 nt, Artificial Sequence
  Description of Artificial Sequence: Synthetic oligonucleotide
gucaucuugggauccgaau

SEQ ID NO: 1667 - RNA, 19 nt, Artificial Sequence
  Description of Artificial Sequence: Synthetic oligonucleotide
uucggaucccaagaugaca

SEQ ID NO: 1668 - RNA, 19 nt, Artificial Sequence
  Description of Artificial Sequence: Synthetic oligonucleotide
ugucaucuugggauccgaa

SEQ ID NO: 1669 - RNA, 19 nt, Artificial Sequence
  Description of Artificial Sequence: Synthetic oligonucleotide
acaugcucgccuuucuggg

SEQ ID NO: 1670 - RNA, 19 nt, Artificial Sequence
  Description of Artificial Sequence: Synthetic oligonucleotide
cccagaaaggcgagcaugu

SEQ ID NO: 1671 - RNA, 19 nt, Artificial Sequence
  Description of Artificial Sequence: Synthetic oligonucleotide
aaaaugcagaggucaaaga

SEQ ID NO: 1672 - RNA, 19 nt, Artificial Sequence
  Description of Artificial Sequence: Synthetic oligonucleotide
ucuuugaccucugcauuuu

SEQ ID NO: 1673 - RNA, 19 nt, Artificial Sequence
  Description of Artificial Sequence: Synthetic oligonucleotide
agaugaugacuacauggac

SEQ ID NO: 1674 - RNA, 19 nt, Artificial Sequence
  Description of Artificial Sequence: Synthetic oligonucleotide
guccauguagucaucaucu

SEQ ID NO: 1675 - RNA, 19 nt, Artificial Sequence
  Description of Artificial Sequence: Synthetic oligonucleotide
augaugacuacauggacuc

SEQ ID NO: 1676 - RNA, 19 nt, Artificial Sequence
  Description of Artificial Sequence: Synthetic oligonucleotide
gaguccauguagucaucau

SEQ ID NO: 1677 - RNA, 19 nt, Artificial Sequence
  Description of Artificial Sequence: Synthetic oligonucleotide
ugaugacuacauggacucu

SEQ ID NO: 1678 - RNA, 19 nt, Artificial Sequence
  Description of Artificial Sequence: Synthetic oligonucleotide
agaguccauguagucauca

SEQ ID NO: 1679 - RNA, 19 nt, Artificial Sequence
  Description of Artificial Sequence: Synthetic oligonucleotide
gaugacuacauggacucuc

SEQ ID NO: 1680 - RNA, 19 nt, Artificial Sequence
  Description of Artificial Sequence: Synthetic oligonucleotide
gagaguccauguagucauc

SEQ ID NO: 1681 - RNA, 19 nt, Artificial Sequence
  Description of Artificial Sequence: Synthetic oligonucleotide
gacggguguucacuccgac

SEQ ID NO: 1682 - RNA, 19 nt, Artificial Sequence
  Description of Artificial Sequence: Synthetic oligonucleotide
gucggagugaacacccguc

SEQ ID NO: 1683 - RNA, 19 nt, Artificial Sequence
  Description of Artificial Sequence: Synthetic oligonucleotide
acggguguucacuccgacu

SEQ ID NO: 1684 - RNA, 19 nt, Artificial Sequence
  Description of Artificial Sequence: Synthetic oligonucleotide
agucggagugaacacccgu

SEQ ID NO: 1685 - RNA, 19 nt, Artificial Sequence
  Description of Artificial Sequence: Synthetic oligonucleotide
cggguguucacuccgacug

SEQ ID NO: 1686 - RNA, 19 nt, Artificial Sequence
  Description of Artificial Sequence: Synthetic oligonucleotide
cagucggagugaacacccg

SEQ ID NO: 1687 - RNA, 19 nt, Artificial Sequence
  Description of Artificial Sequence: Synthetic oligonucleotide
ggguguucacuccgacugc

SEQ ID NO: 1688 - RNA, 19 nt, Artificial Sequence
  Description of Artificial Sequence: Synthetic oligonucleotide
gcagucggagugaacaccc

SEQ ID NO: 1689 - RNA, 19 nt, Artificial Sequence
  Description of Artificial Sequence: Synthetic oligonucleotide
gguguucacuccgacugca

SEQ ID NO: 1690 - RNA, 19 nt, Artificial Sequence
  Description of Artificial Sequence: Synthetic oligonucleotide
ugcagucggagugaacacc

SEQ ID NO: 1691 - RNA, 19 nt, Artificial Sequence
  Description of Artificial Sequence: Synthetic oligonucleotide
guguucacuccgacugcaa

SEQ ID NO: 1692 - RNA, 19 nt, Artificial Sequence
  Description of Artificial Sequence: Synthetic oligonucleotide
uugcagucggagugaacac

SEQ ID NO: 1693 - RNA, 19 nt, Artificial Sequence
  Description of Artificial Sequence: Synthetic oligonucleotide
uguucacuccgacugcaac

SEQ ID NO: 1694 - RNA, 19 nt, Artificial Sequence
  Description of Artificial Sequence: Synthetic oligonucleotide
guugcagucggagugaaca

SEQ ID NO: 1695 - RNA, 19 nt, Artificial Sequence
  Description of Artificial Sequence: Synthetic oligonucleotide
agagguaccuguggcauau

SEQ ID NO: 1696 - RNA, 19 nt, Artificial Sequence
  Description of Artificial Sequence: Synthetic oligonucleotide
auaugccacagguaccucu

SEQ ID NO: 1697 - RNA, 19 nt, Artificial Sequence
  Description of Artificial Sequence: Synthetic oligonucleotide
ccuguggcauaucccauug

SEQ ID NO: 1698 - RNA, 19 nt, Artificial Sequence
  Description of Artificial Sequence: Synthetic oligonucleotide
caaugggauaugccacagg

SEQ ID NO: 1699 - RNA, 19 nt, Artificial Sequence
  Description of Artificial Sequence: Synthetic oligonucleotide
cuguggcauaucccauuga

SEQ ID NO: 1700 - RNA, 19 nt, Artificial Sequence
  Description of Artificial Sequence: Synthetic oligonucleotide
ucaaugggauaugccacag

SEQ ID NO: 1701 - RNA, 19 nt, Artificial Sequence
  Description of Artificial Sequence: Synthetic oligonucleotide
cauaucccauugaccuacu

SEQ ID NO: 1702 - RNA, 19 nt, Artificial Sequence
  Description of Artificial Sequence: Synthetic oligonucleotide
aguaggucaaugggauaug

SEQ ID NO: 1703 - RNA, 19 nt, Artificial Sequence
  Description of Artificial Sequence: Synthetic oligonucleotide
auaucccauugaccuacuc

SEQ ID NO: 1704 - RNA, 19 nt, Artificial Sequence
  Description of Artificial Sequence: Synthetic oligonucleotide
gaguaggucaaugggauau

SEQ ID NO: 1705 - RNA, 19 nt, Artificial Sequence
  Description of Artificial Sequence: Synthetic oligonucleotide
uaucccauugaccuacucc

SEQ ID NO: 1706 - RNA, 19 nt, Artificial Sequence
  Description of Artificial Sequence: Synthetic oligonucleotide
ggaguaggucaaugggaua

SEQ ID NO: 1707 - RNA, 19 nt, Artificial Sequence
  Description of Artificial Sequence: Synthetic oligonucleotide
ccauugaccuacuccacga

SEQ ID NO: 1708 - RNA, 19 nt, Artificial Sequence
  Description of Artificial Sequence: Synthetic oligonucleotide
ucguggaguaggucaaugg

SEQ ID NO: 1709 - RNA, 19 nt, Artificial Sequence
  Description of Artificial Sequence: Synthetic oligonucleotide
cauugaccuacuccacgag

SEQ ID NO: 1710 - RNA, 19 nt, Artificial Sequence
  Description of Artificial Sequence: Synthetic oligonucleotide
cucguggaguaggucaaug

SEQ ID NO: 1711 - RNA, 19 nt, Artificial Sequence
  Description of Artificial Sequence: Synthetic oligonucleotide
cuccacgaguucuucuaau

SEQ ID NO: 1712 - RNA, 19 nt, Artificial Sequence
  Description of Artificial Sequence: Synthetic oligonucleotide
auuagaagaacucguggag

SEQ ID NO: 1713 - RNA, 19 nt, Artificial Sequence
  Description of Artificial Sequence: Synthetic oligonucleotide
uccacgaguucuucuaaug

SEQ ID NO: 1714 - RNA, 19 nt, Artificial Sequence
  Description of Artificial Sequence: Synthetic oligonucleotide
cauuagaagaacucgugga

SEQ ID NO: 1715 - RNA, 19 nt, Artificial Sequence
  Description of Artificial Sequence: Synthetic oligonucleotide
aguucuucuaaugugaucc

SEQ ID NO: 1716 - RNA, 19 nt, Artificial Sequence
  Description of Artificial Sequence: Synthetic oligonucleotide
ggaucacauuagaagaacu

SEQ ID NO: 1717 - RNA, 19 nt, Artificial Sequence
  Description of Artificial Sequence: Synthetic oligonucleotide
guucuucuaaugugaucca

SEQ ID NO: 1718 - RNA, 19 nt, Artificial Sequence
  Description of Artificial Sequence: Synthetic oligonucleotide
uggaucacauuagaagaac

SEQ ID NO: 1719 - RNA, 19 nt, Artificial Sequence
  Description of Artificial Sequence: Synthetic oligonucleotide
uucuucuaaugugauccac

SEQ ID NO: 1720 - RNA, 19 nt, Artificial Sequence
  Description of Artificial Sequence: Synthetic oligonucleotide
guggaucacauuagaagaa

SEQ ID NO: 1721 - RNA, 19 nt, Artificial Sequence
  Description of Artificial Sequence: Synthetic oligonucleotide
aaaagaccaguugggugaa

SEQ ID NO: 1722 - RNA, 19 nt, Artificial Sequence
  Description of Artificial Sequence: Synthetic oligonucleotide
uucacccaacuggucuuuu

SEQ ID NO: 1723 - RNA, 19 nt, Artificial Sequence
  Description of Artificial Sequence: Synthetic oligonucleotide
uuuaauguggacucaaaug

SEQ ID NO: 1724 - RNA, 19 nt, Artificial Sequence
  Description of Artificial Sequence: Synthetic oligonucleotide
cauuugaguccacauuaaa

SEQ ID NO: 1725 - RNA, 19 nt, Artificial Sequence
  Description of Artificial Sequence: Synthetic oligonucleotide
uuaauguggacucaaaugg

SEQ ID NO: 1726 - RNA, 19 nt, Artificial Sequence
  Description of Artificial Sequence: Synthetic oligonucleotide
ccauuugaguccacauuaa

SEQ ID NO: 1727 - RNA, 19 nt, Artificial Sequence
  Description of Artificial Sequence: Synthetic oligonucleotide
uaauguggacucaaauggu

SEQ ID NO: 1728 - RNA, 19 nt, Artificial Sequence
  Description of Artificial Sequence: Synthetic oligonucleotide
accauuugaguccacauua

SEQ ID NO: 1729 - RNA, 19 nt, Artificial Sequence
  Description of Artificial Sequence: Synthetic oligonucleotide
aauguggacucaaaugguu

SEQ ID NO: 1730 - RNA, 19 nt, Artificial Sequence
  Description of Artificial Sequence: Synthetic oligonucleotide
aaccauuugaguccacauu

SEQ ID NO: 1731 - RNA, 19 nt, Artificial Sequence
  Description of Artificial Sequence: Synthetic oligonucleotide
auguggacucaaaugguua

SEQ ID NO: 1732 - RNA, 19 nt, Artificial Sequence
  Description of Artificial Sequence: Synthetic oligonucleotide
uaaccauuugaguccacau

SEQ ID NO: 1733 - RNA, 19 nt, Artificial Sequence
  Description of Artificial Sequence: Synthetic oligonucleotide
uguggacucaaaugguuac

SEQ ID NO: 1734 - RNA, 19 nt, Artificial Sequence
  Description of Artificial Sequence: Synthetic oligonucleotide
guaaccauuugaguccaca

SEQ ID NO: 1735 - RNA, 19 nt, Artificial Sequence
  Description of Artificial Sequence: Synthetic oligonucleotide
guggacucaaaugguuacu

SEQ ID NO: 1736 - RNA, 19 nt, Artificial Sequence
  Description of Artificial Sequence: Synthetic oligonucleotide
aguaaccauuugaguccac

SEQ ID NO: 1737 - RNA, 19 nt, Artificial Sequence
  Description of Artificial Sequence: Synthetic oligonucleotide
uggacucaaaugguuacua

SEQ ID NO: 1738 - RNA, 19 nt, Artificial Sequence
  Description of Artificial Sequence: Synthetic oligonucleotide
uaguaaccauuugagucca

SEQ ID NO: 1739 - RNA, 19 nt, Artificial Sequence
  Description of Artificial Sequence: Synthetic oligonucleotide
ggacucaaaugguuacuac

SEQ ID NO: 1740 - RNA, 19 nt, Artificial Sequence
  Description of Artificial Sequence: Synthetic oligonucleotide
guaguaaccauuugagucc

SEQ ID NO: 1741 - RNA, 19 nt, Artificial Sequence
  Description of Artificial Sequence: Synthetic oligonucleotide
gacucaaaugguuacuaca

SEQ ID NO: 1742 - RNA, 19 nt, Artificial Sequence
  Description of Artificial Sequence: Synthetic oligonucleotide
uguaguaaccauuugaguc

SEQ ID NO: 1743 - RNA, 19 nt, Artificial Sequence
  Description of Artificial Sequence: Synthetic oligonucleotide
caaaugguuacuacaucgu

SEQ ID NO: 1744 - RNA, 19 nt, Artificial Sequence
  Description of Artificial Sequence: Synthetic oligonucleotide
acgauguaguaaccauuug

SEQ ID NO: 1745 - RNA, 19 nt, Artificial Sequence
  Description of Artificial Sequence: Synthetic oligonucleotide
aaugguuacuacaucguuc

SEQ ID NO: 1746 - RNA, 19 nt, Artificial Sequence
  Description of Artificial Sequence: Synthetic oligonucleotide
gaacgauguaguaaccauu

SEQ ID NO: 1747 - RNA, 19 nt, Artificial Sequence
  Description of Artificial Sequence: Synthetic oligonucleotide
augguuacuacaucguuca

SEQ ID NO: 1748 - RNA, 19 nt, Artificial Sequence
  Description of Artificial Sequence: Synthetic oligonucleotide
ugaacgauguaguaaccau

SEQ ID NO: 1749 - RNA, 19 nt, Artificial Sequence
  Description of Artificial Sequence: Synthetic oligonucleotide
ugguuacuacaucguucac

SEQ ID NO: 1750 - RNA, 19 nt, Artificial Sequence
  Description of Artificial Sequence: Synthetic oligonucleotide
gugaacgauguaguaacca

SEQ ID NO: 1751 - RNA, 19 nt, Artificial Sequence
  Description of Artificial Sequence: Synthetic oligonucleotide
gguuacuacaucguucacu

SEQ ID NO: 1752 - RNA, 19 nt, Artificial Sequence
  Description of Artificial Sequence: Synthetic oligonucleotide
agugaacgauguaguaacc

SEQ ID NO: 1753 - RNA, 19 nt, Artificial Sequence
  Description of Artificial Sequence: Synthetic oligonucleotide
guuacuacaucguucacua

SEQ ID NO: 1754 - RNA, 19 nt, Artificial Sequence
  Description of Artificial Sequence: Synthetic oligonucleotide
uagugaacgauguaguaac

SEQ ID NO: 1755 - RNA, 19 nt, Artificial Sequence
  Description of Artificial Sequence: Synthetic oligonucleotide
uuacuacaucguucacuau

SEQ ID NO: 1756 - RNA, 19 nt, Artificial Sequence
  Description of Artificial Sequence: Synthetic oligonucleotide
auagugaacgauguaguaa

SEQ ID NO: 1757 - RNA, 19 nt, Artificial Sequence
  Description of Artificial Sequence: Synthetic oligonucleotide
uacuacaucguucacuaug

SEQ ID NO: 1758 - RNA, 19 nt, Artificial Sequence
  Description of Artificial Sequence: Synthetic oligonucleotide
cauagugaacgauguagua

SEQ ID NO: 1759 - RNA, 19 nt, Artificial Sequence
  Description of Artificial Sequence: Synthetic oligonucleotide
acaucguucacuaugaggg

SEQ ID NO: 1760 - RNA, 19 nt, Artificial Sequence
  Description of Artificial Sequence: Synthetic oligonucleotide
cccucauagugaacgaugu

SEQ ID NO: 1761 - RNA, 19 nt, Artificial Sequence
  Description of Artificial Sequence: Synthetic oligonucleotide
caucguucacuaugagggu

SEQ ID NO: 1762 - RNA, 19 nt, Artificial Sequence
  Description of Artificial Sequence: Synthetic oligonucleotide
acccucauagugaacgaug

SEQ ID NO: 1763 - RNA, 19 nt, Artificial Sequence
  Description of Artificial Sequence: Synthetic oligonucleotide
ugagggucauggaugggac

SEQ ID NO: 1764 - RNA, 19 nt, Artificial Sequence
  Description of Artificial Sequence: Synthetic oligonucleotide
gucccauccaugacccuca

SEQ ID NO: 1765 - RNA, 19 nt, Artificial Sequence
  Description of Artificial Sequence: Synthetic oligonucleotide
cacacuucucagaccuaag

SEQ ID NO: 1766 - RNA, 19 nt, Artificial Sequence
  Description of Artificial Sequence: Synthetic oligonucleotide
cuuaggucugagaagugug

SEQ ID NO: 1767 - RNA, 19 nt, Artificial Sequence
  Description of Artificial Sequence: Synthetic oligonucleotide
acacuucucagaccuaagg

SEQ ID NO: 1768 - RNA, 19 nt, Artificial Sequence
  Description of Artificial Sequence: Synthetic oligonucleotide
ccuuaggucugagaagugu

SEQ ID NO: 1769 - RNA, 19 nt, Artificial Sequence
  Description of Artificial Sequence: Synthetic oligonucleotide
cacuucucagaccuaagga

SEQ ID NO: 1770 - RNA, 19 nt, Artificial Sequence
  Description of Artificial Sequence: Synthetic oligonucleotide
uccuuaggucugagaagug

SEQ ID NO: 1771 - RNA, 19 nt, Artificial Sequence
  Description of Artificial Sequence: Synthetic oligonucleotide
acuucucagaccuaaggac

SEQ ID NO: 1772 - RNA, 19 nt, Artificial Sequence
  Description of Artificial Sequence: Synthetic oligonucleotide
guccuuaggucugagaagu

SEQ ID NO: 1773 - RNA, 19 nt, Artificial Sequence
  Description of Artificial Sequence: Synthetic oligonucleotide
uucucagaccuaaggacag

SEQ ID NO: 1774 - RNA, 19 nt, Artificial Sequence
  Description of Artificial Sequence: Synthetic oligonucleotide
cuguccuuaggucugagaa

SEQ ID NO: 1775 - RNA, 19 nt, Artificial Sequence
  Description of Artificial Sequence: Synthetic oligonucleotide
ucucagaccuaaggacaga

SEQ ID NO: 1776 - RNA, 19 nt, Artificial Sequence
  Description of Artificial Sequence: Synthetic oligonucleotide
ucuguccuuaggucugaga

SEQ ID NO: 1777 - RNA, 19 nt, Artificial Sequence
  Description of Artificial Sequence: Synthetic oligonucleotide
cucagaccuaaggacagag

SEQ ID NO: 1778 - RNA, 19 nt, Artificial Sequence
  Description of Artificial Sequence: Synthetic oligonucleotide
cucuguccuuaggucugag

SEQ ID NO: 1779 - RNA, 19 nt, Artificial Sequence
  Description of Artificial Sequence: Synthetic oligonucleotide
ucagaccuaaggacagagu

SEQ ID NO: 1780 - RNA, 19 nt, Artificial Sequence
  Description of Artificial Sequence: Synthetic oligonucleotide
acucuguccuuaggucuga

SEQ ID NO: 1781 - RNA, 19 nt, Artificial Sequence
  Description of Artificial Sequence: Synthetic oligonucleotide
cagaccuaaggacagagua

SEQ ID NO: 1782 - RNA, 19 nt, Artificial Sequence
  Description of Artificial Sequence: Synthetic oligonucleotide
uacucuguccuuaggucug

SEQ ID NO: 1783 - RNA, 19 nt, Artificial Sequence
  Description of Artificial Sequence: Synthetic oligonucleotide
agaccuaaggacagaguag

SEQ ID NO: 1784 - RNA, 19 nt, Artificial Sequence
  Description of Artificial Sequence: Synthetic oligonucleotide
cuacucuguccuuaggucu

SEQ ID NO: 1785 - RNA, 19 nt, Artificial Sequence
  Description of Artificial Sequence: Synthetic oligonucleotide
ucugauucaugauguguuu

SEQ ID NO: 1786 - RNA, 19 nt, Artificial Sequence
  Description of Artificial Sequence: Synthetic oligonucleotide
aaacacaucaugaaucaga

SEQ ID NO: 1787 - RNA, 19 nt, Artificial Sequence
  Description of Artificial Sequence: Synthetic oligonucleotide
auucaugauguguuucagc

SEQ ID NO: 1788 - RNA, 19 nt, Artificial Sequence
  Description of Artificial Sequence: Synthetic oligonucleotide
gcugaaacacaucaugaau

SEQ ID NO: 1789 - RNA, 19 nt, Artificial Sequence
  Description of Artificial Sequence: Synthetic oligonucleotide
caaagcucuugacaugacu

SEQ ID NO: 1790 - RNA, 19 nt, Artificial Sequence
  Description of Artificial Sequence: Synthetic oligonucleotide
agucaugucaagagcuuug

SEQ ID NO: 1791 - RNA, 19 nt, Artificial Sequence
  Description of Artificial Sequence: Synthetic oligonucleotide
aaagcucuugacaugacuu

SEQ ID NO: 1792 - RNA, 19 nt, Artificial Sequence
  Description of Artificial Sequence: Synthetic oligonucleotide
aagucaugucaagagcuuu

SEQ ID NO: 1793 - RNA, 19 nt, Artificial Sequence
  Description of Artificial Sequence: Synthetic oligonucleotide
aagcucuugacaugacuua

SEQ ID NO: 1794 - RNA, 19 nt, Artificial Sequence
  Description of Artificial Sequence: Synthetic oligonucleotide
uaagucaugucaagagcuu

SEQ ID NO: 1795 - RNA, 19 nt, Artificial Sequence
  Description of Artificial Sequence: Synthetic oligonucleotide
agcucuugacaugacuuac

SEQ ID NO: 1796 - RNA, 19 nt, Artificial Sequence
  Description of Artificial Sequence: Synthetic oligonucleotide
guaagucaugucaagagcu

SEQ ID NO: 1797 - RNA, 19 nt, Artificial Sequence
  Description of Artificial Sequence: Synthetic oligonucleotide
gcucuugacaugacuuacu

SEQ ID NO: 1798 - RNA, 19 nt, Artificial Sequence
  Description of Artificial Sequence: Synthetic oligonucleotide
aguaagucaugucaagagc

SEQ ID NO: 1799 - RNA, 19 nt, Artificial Sequence
  Description of Artificial Sequence: Synthetic oligonucleotide
cucuugacaugacuuacua

SEQ ID NO: 1800 - RNA, 19 nt, Artificial Sequence
  Description of Artificial Sequence: Synthetic oligonucleotide
uaguaagucaugucaagag

SEQ ID NO: 1801 - RNA, 19 nt, Artificial Sequence
  Description of Artificial Sequence: Synthetic oligonucleotide
ucuugacaugacuuacuac

SEQ ID NO: 1802 - RNA, 19 nt, Artificial Sequence
  Description of Artificial Sequence: Synthetic oligonucleotide
guaguaagucaugucaaga

SEQ ID NO: 1803 - RNA, 19 nt, Artificial Sequence
  Description of Artificial Sequence: Synthetic oligonucleotide
cuugacaugacuuacuacc

SEQ ID NO: 1804 - RNA, 19 nt, Artificial Sequence
  Description of Artificial Sequence: Synthetic oligonucleotide
gguaguaagucaugucaag

SEQ ID NO: 1805 - RNA, 19 nt, Artificial Sequence
  Description of Artificial Sequence: Synthetic oligonucleotide
cccgcacuucucgaagguc

SEQ ID NO: 1806 - RNA, 19 nt, Artificial Sequence
  Description of Artificial Sequence: Synthetic oligonucleotide
gaccuucgagaagugcggg

SEQ ID NO: 1807 - RNA, 19 nt, Artificial Sequence
  Description of Artificial Sequence: Synthetic oligonucleotide
ccgcacuucucgaaggucu

SEQ ID NO: 1808 - RNA, 19 nt, Artificial Sequence
  Description of Artificial Sequence: Synthetic oligonucleotide
agaccuucgagaagugcgg

SEQ ID NO: 1809 - RNA, 19 nt, Artificial Sequence
  Description of Artificial Sequence: Synthetic oligonucleotide
gcacuucucgaaggucuga

SEQ ID NO: 1810 - RNA, 19 nt, Artificial Sequence
  Description of Artificial Sequence: Synthetic oligonucleotide
ucagaccuucgagaagugc

SEQ ID NO: 1811 - RNA, 19 nt, Artificial Sequence
  Description of Artificial Sequence: Synthetic oligonucleotide
cacuucucgaaggucugag

SEQ ID NO: 1812 - RNA, 19 nt, Artificial Sequence
  Description of Artificial Sequence: Synthetic oligonucleotide
cucagaccuucgagaagug

SEQ ID NO: 1813 - RNA, 19 nt, Artificial Sequence
  Description of Artificial Sequence: Synthetic oligonucleotide
ucucgaaggucugaguuac

SEQ ID NO: 1814 - RNA, 19 nt, Artificial Sequence
  Description of Artificial Sequence: Synthetic oligonucleotide
guaacucagaccuucgaga

SEQ ID NO: 1815 - RNA, 19 nt, Artificial Sequence
  Description of Artificial Sequence: Synthetic oligonucleotide
cucgaaggucugaguuacu

SEQ ID NO: 1816 - RNA, 19 nt, Artificial Sequence
  Description of Artificial Sequence: Synthetic oligonucleotide
aguaacucagaccuucgag

SEQ ID NO: 1817 - RNA, 19 nt, Artificial Sequence
  Description of Artificial Sequence: Synthetic oligonucleotide
ucgaaggucugaguuacuu

SEQ ID NO: 1818 - RNA, 19 nt, Artificial Sequence
  Description of Artificial Sequence: Synthetic oligonucleotide
aaguaacucagaccuucga

SEQ ID NO: 1819 - RNA, 19 nt, Artificial Sequence
  Description of Artificial Sequence: Synthetic oligonucleotide
cgaaggucugaguuacuug

SEQ ID NO: 1820 - RNA, 19 nt, Artificial Sequence
  Description of Artificial Sequence: Synthetic oligonucleotide
caaguaacucagaccuucg

SEQ ID NO: 1821 - RNA, 19 nt, Artificial Sequence
  Description of Artificial Sequence: Synthetic oligonucleotide
aaggucugaguuacuugga

SEQ ID NO: 1822 - RNA, 19 nt, Artificial Sequence
  Description of Artificial Sequence: Synthetic oligonucleotide
uccaaguaacucagaccuu

SEQ ID NO: 1823 - RNA, 19 nt, Artificial Sequence
  Description of Artificial Sequence: Synthetic oligonucleotide
aggucugaguuacuuggaa

SEQ ID NO: 1824 - RNA, 19 nt, Artificial Sequence
  Description of Artificial Sequence: Synthetic oligonucleotide
uuccaaguaacucagaccu

SEQ ID NO: 1825 - RNA, 19 nt, Artificial Sequence
  Description of Artificial Sequence: Synthetic oligonucleotide
ggucugaguuacuuggaau

SEQ ID NO: 1826 - RNA, 19 nt, Artificial Sequence
  Description of Artificial Sequence: Synthetic oligonucleotide
auuccaaguaacucagacc

SEQ ID NO: 1827 - RNA, 19 nt, Artificial Sequence
  Description of Artificial Sequence: Synthetic oligonucleotide
gucugaguuacuuggaauc

SEQ ID NO: 1828 - RNA, 19 nt, Artificial Sequence
  Description of Artificial Sequence: Synthetic oligonucleotide
gauuccaaguaacucagac

SEQ ID NO: 1829 - RNA, 19 nt, Artificial Sequence
  Description of Artificial Sequence: Synthetic oligonucleotide
ucugaguuacuuggaaucg

SEQ ID NO: 1830 - RNA, 19 nt, Artificial Sequence
  Description of Artificial Sequence: Synthetic oligonucleotide
cgauuccaaguaacucaga

SEQ ID NO: 1831 - RNA, 19 nt, Artificial Sequence
  Description of Artificial Sequence: Synthetic oligonucleotide
cugaguuacuuggaaucgu

SEQ ID NO: 1832 - RNA, 19 nt, Artificial Sequence
  Description of Artificial Sequence: Synthetic oligonucleotide
acgauuccaaguaacucag

SEQ ID NO: 1833 - RNA, 19 nt, Artificial Sequence
  Description of Artificial Sequence: Synthetic oligonucleotide
ugaguuacuuggaaucguu

SEQ ID NO: 1834 - RNA, 19 nt, Artificial Sequence
  Description of Artificial Sequence: Synthetic oligonucleotide
aacgauuccaaguaacuca

SEQ ID NO: 1835 - RNA, 19 nt, Artificial Sequence
  Description of Artificial Sequence: Synthetic oligonucleotide
gaguuacuuggaaucguuu

SEQ ID NO: 1836 - RNA, 19 nt, Artificial Sequence
  Description of Artificial Sequence: Synthetic oligonucleotide
aaacgauuccaaguaacuc

SEQ ID NO: 1837 - RNA, 19 nt, Artificial Sequence
  Description of Artificial Sequence: Synthetic oligonucleotide
aguuacuuggaaucguuuu

SEQ ID NO: 1838 - RNA, 19 nt, Artificial Sequence
  Description of Artificial Sequence: Synthetic oligonucleotide
aaaacgauuccaaguaacu

SEQ ID NO: 1839 - RNA, 19 nt, Artificial Sequence
  Description of Artificial Sequence: Synthetic oligonucleotide
guuacuuggaaucguuuua

SEQ ID NO: 1840 - RNA, 19 nt, Artificial Sequence
  Description of Artificial Sequence: Synthetic oligonucleotide
uaaaacgauuccaaguaac

SEQ ID NO: 1841 - RNA, 19 nt, Artificial Sequence
  Description of Artificial Sequence: Synthetic oligonucleotide
uuacuuggaaucguuuuac

SEQ ID NO: 1842 - RNA, 19 nt, Artificial Sequence
  Description of Artificial Sequence: Synthetic oligonucleotide
guaaaacgauuccaaguaa

SEQ ID NO: 1843 - RNA, 19 nt, Artificial Sequence
  Description of Artificial Sequence: Synthetic oligonucleotide
uacuuggaaucguuuuacc

SEQ ID NO: 1844 - RNA, 19 nt, Artificial Sequence
  Description of Artificial Sequence: Synthetic oligonucleotide
gguaaaacgauuccaagua

SEQ ID NO: 1845 - RNA, 19 nt, Artificial Sequence
  Description of Artificial Sequence: Synthetic oligonucleotide
acuuggaaucguuuuacca

SEQ ID NO: 1846 - RNA, 19 nt, Artificial Sequence
  Description of Artificial Sequence: Synthetic oligonucleotide
ugguaaaacgauuccaagu

SEQ ID NO: 1847 - RNA, 19 nt, Artificial Sequence
  Description of Artificial Sequence: Synthetic oligonucleotide
cuuggaaucguuuuaccac

SEQ ID NO: 1848 - RNA, 19 nt, Artificial Sequence
  Description of Artificial Sequence: Synthetic oligonucleotide
gugguaaaacgauuccaag

SEQ ID NO: 1849 - RNA, 19 nt, Artificial Sequence
  Description of Artificial Sequence: Synthetic oligonucleotide
uuggaaucguuuuaccaca

SEQ ID NO: 1850 - RNA, 19 nt, Artificial Sequence
  Description of Artificial Sequence: Synthetic oligonucleotide
ugugguaaaacgauuccaa

SEQ ID NO: 1851 - RNA, 19 nt, Artificial Sequence
  Description of Artificial Sequence: Synthetic oligonucleotide
aaucguuuuaccacaugau

SEQ ID NO: 1852 - RNA, 19 nt, Artificial Sequence
  Description of Artificial Sequence: Synthetic oligonucleotide
aucaugugguaaaacgauu

SEQ ID NO: 1853 - RNA, 19 nt, Artificial Sequence
  Description of Artificial Sequence: Synthetic oligonucleotide
aucguuuuaccacaugaug

SEQ ID NO: 1854 - RNA, 19 nt, Artificial Sequence
  Description of Artificial Sequence: Synthetic oligonucleotide
caucaugugguaaaacgau

SEQ ID NO: 1855 - RNA, 19 nt, Artificial Sequence
  Description of Artificial Sequence: Synthetic oligonucleotide
ucguuuuaccacaugaugg

SEQ ID NO: 1856 - RNA, 19 nt, Artificial Sequence
  Description of Artificial Sequence: Synthetic oligonucleotide
ccaucaugugguaaaacga

SEQ ID NO: 1857 - RNA, 19 nt, Artificial Sequence
  Description of Artificial Sequence: Synthetic oligonucleotide
cguuuuaccacaugaugga

SEQ ID NO: 1858 - RNA, 19 nt, Artificial Sequence
  Description of Artificial Sequence: Synthetic oligonucleotide
uccaucaugugguaaaacg

SEQ ID NO: 1859 - RNA, 19 nt, Artificial Sequence
  Description of Artificial Sequence: Synthetic oligonucleotide
guuuuaccacaugauggac

SEQ ID NO: 1860 - RNA, 19 nt, Artificial Sequence
  Description of Artificial Sequence: Synthetic oligonucleotide
guccaucaugugguaaaac

SEQ ID NO: 1861 - RNA, 19 nt, Artificial Sequence
  Description of Artificial Sequence: Synthetic oligonucleotide
uuuaccacaugauggacag

SEQ ID NO: 1862 - RNA, 19 nt, Artificial Sequence
  Description of Artificial Sequence: Synthetic oligonucleotide
cuguccaucaugugguaaa

SEQ ID NO: 1863 - RNA, 19 nt, Artificial Sequence
  Description of Artificial Sequence: Synthetic oligonucleotide
uuaccacaugauggacaga

SEQ ID NO: 1864 - RNA, 19 nt, Artificial Sequence
  Description of Artificial Sequence: Synthetic oligonucleotide
ucuguccaucaugugguaa

SEQ ID NO: 1865 - RNA, 19 nt, Artificial Sequence
  Description of Artificial Sequence: Synthetic oligonucleotide
uaccacaugauggacagaa

SEQ ID NO: 1866 - RNA, 19 nt, Artificial Sequence
  Description of Artificial Sequence: Synthetic oligonucleotide
uucuguccaucauguggua

SEQ ID NO: 1867 - RNA, 19 nt, Artificial Sequence
  Description of Artificial Sequence: Synthetic oligonucleotide
accacaugauggacagaag

SEQ ID NO: 1868 - RNA, 19 nt, Artificial Sequence
  Description of Artificial Sequence: Synthetic oligonucleotide
cuucuguccaucauguggu

SEQ ID NO: 1869 - RNA, 19 nt, Artificial Sequence
  Description of Artificial Sequence: Synthetic oligonucleotide
caugauggacagaaggaau

SEQ ID NO: 1870 - RNA, 19 nt, Artificial Sequence
  Description of Artificial Sequence: Synthetic oligonucleotide
auuccuucuguccaucaug

SEQ ID NO: 1871 - RNA, 19 nt, Artificial Sequence
  Description of Artificial Sequence: Synthetic oligonucleotide
ugauggacagaaggaauau

SEQ ID NO: 1872 - RNA, 19 nt, Artificial Sequence
  Description of Artificial Sequence: Synthetic oligonucleotide
auauuccuucuguccauca

SEQ ID NO: 1873 - RNA, 19 nt, Artificial Sequence
  Description of Artificial Sequence: Synthetic oligonucleotide
gauggacagaaggaauauu

SEQ ID NO: 1874 - RNA, 19 nt, Artificial Sequence
  Description of Artificial Sequence: Synthetic oligonucleotide
aauauuccuucuguccauc

SEQ ID NO: 1875 - RNA, 19 nt, Artificial Sequence
  Description of Artificial Sequence: Synthetic oligonucleotide
auggacagaaggaauauuu

SEQ ID NO: 1876 - RNA, 19 nt, Artificial Sequence
  Description of Artificial Sequence: Synthetic oligonucleotide
aaauauuccuucuguccau

SEQ ID NO: 1877 - RNA, 19 nt, Artificial Sequence
  Description of Artificial Sequence: Synthetic oligonucleotide
uggacagaaggaauauuuc

SEQ ID NO: 1878 - RNA, 19 nt, Artificial Sequence
  Description of Artificial Sequence: Synthetic oligonucleotide
gaaauauuccuucugucca

SEQ ID NO: 1879 - RNA, 19 nt, Artificial Sequence
  Description of Artificial Sequence: Synthetic oligonucleotide
cagaaggaauauuucagau

SEQ ID NO: 1880 - RNA, 19 nt, Artificial Sequence
  Description of Artificial Sequence: Synthetic oligonucleotide
aucugaaauauuccuucug

SEQ ID NO: 1881 - RNA, 19 nt, Artificial Sequence
  Description of Artificial Sequence: Synthetic oligonucleotide
cucaagcguuaccuucuuc

SEQ ID NO: 1882 - RNA, 19 nt, Artificial Sequence
  Description of Artificial Sequence: Synthetic oligonucleotide
gaagaagguaacgcuugag

SEQ ID NO: 1883 - RNA, 19 nt, Artificial Sequence
  Description of Artificial Sequence: Synthetic oligonucleotide
agcguuaccuucuucagua

SEQ ID NO: 1884 - RNA, 19 nt, Artificial Sequence
  Description of Artificial Sequence: Synthetic oligonucleotide
uacugaagaagguaacgcu

SEQ ID NO: 1885 - RNA, 19 nt, Artificial Sequence
  Description of Artificial Sequence: Synthetic oligonucleotide
gcguuaccuucuucaguau

SEQ ID NO: 1886 - RNA, 19 nt, Artificial Sequence
  Description of Artificial Sequence: Synthetic oligonucleotide
auacugaagaagguaacgc

SEQ ID NO: 1887 - RNA, 19 nt, Artificial Sequence
  Description of Artificial Sequence: Synthetic oligonucleotide
ccuucuucaguauuuuaag

SEQ ID NO: 1888 - RNA, 19 nt, Artificial Sequence
  Description of Artificial Sequence: Synthetic oligonucleotide
cuuaaaauacugaagaagg

SEQ ID NO: 1889 - RNA, 19 nt, Artificial Sequence
  Description of Artificial Sequence: Synthetic oligonucleotide
uucuucaguauuuuaagcc

SEQ ID NO: 1890 - RNA, 19 nt, Artificial Sequence
  Description of Artificial Sequence: Synthetic oligonucleotide
ggcuuaaaauacugaagaa

SEQ ID NO: 1891 - RNA, 19 nt, Artificial Sequence
  Description of Artificial Sequence: Synthetic oligonucleotide
ucuucaguauuuuaagcca

SEQ ID NO: 1892 - RNA, 19 nt, Artificial Sequence
  Description of Artificial Sequence: Synthetic oligonucleotide
uggcuuaaaauacugaaga

SEQ ID NO: 1893 - RNA, 19 nt, Artificial Sequence
  Description of Artificial Sequence: Synthetic oligonucleotide
auuuuaagccagugauuga

SEQ ID NO: 1894 - RNA, 19 nt, Artificial Sequence
  Description of Artificial Sequence: Synthetic oligonucleotide
ucaaucacuggcuuaaaau

SEQ ID NO: 1895 - RNA, 19 nt, Artificial Sequence
  Description of Artificial Sequence: Synthetic oligonucleotide
uuuuaagccagugauugac

SEQ ID NO: 1896 - RNA, 19 nt, Artificial Sequence
  Description of Artificial Sequence: Synthetic oligonucleotide
gucaaucacuggcuuaaaa

SEQ ID NO: 1897 - RNA, 19 nt, Artificial Sequence
  Description of Artificial Sequence: Synthetic oligonucleotide
uuuaagccagugauugaca

SEQ ID NO: 1898 - RNA, 19 nt, Artificial Sequence
  Description of Artificial Sequence: Synthetic oligonucleotide
ugucaaucacuggcuuaaa

SEQ ID NO: 1899 - RNA, 19 nt, Artificial Sequence
  Description of Artificial Sequence: Synthetic oligonucleotide
uuaagccagugauugacag

SEQ ID NO: 1900 - RNA, 19 nt, Artificial Sequence
  Description of Artificial Sequence: Synthetic oligonucleotide
cugucaaucacuggcuuaa

SEQ ID NO: 1901 - RNA, 19 nt, Artificial Sequence
  Description of Artificial Sequence: Synthetic oligonucleotide
uaagccagugauugacagg

SEQ ID NO: 1902 - RNA, 19 nt, Artificial Sequence
  Description of Artificial Sequence: Synthetic oligonucleotide
ccugucaaucacuggcuua

SEQ ID NO: 1903 - RNA, 19 nt, Artificial Sequence
  Description of Artificial Sequence: Synthetic oligonucleotide
aagccagugauugacaggc

SEQ ID NO: 1904 - RNA, 19 nt, Artificial Sequence
  Description of Artificial Sequence: Synthetic oligonucleotide
gccugucaaucacuggcuu

SEQ ID NO: 1905 - RNA, 19 nt, Artificial Sequence
  Description of Artificial Sequence: Synthetic oligonucleotide
cagugauugacaggcaaag

SEQ ID NO: 1906 - RNA, 19 nt, Artificial Sequence
  Description of Artificial Sequence: Synthetic oligonucleotide
cuuugccugucaaucacug

SEQ ID NO: 1907 - RNA, 19 nt, Artificial Sequence
  Description of Artificial Sequence: Synthetic oligonucleotide
agugauugacaggcaaagc

SEQ ID NO: 1908 - RNA, 19 nt, Artificial Sequence
  Description of Artificial Sequence: Synthetic oligonucleotide
gcuuugccugucaaucacu

SEQ ID NO: 1909 - RNA, 19 nt, Artificial Sequence
  Description of Artificial Sequence: Synthetic oligonucleotide
auugacaggcaaagcugga

SEQ ID NO: 1910 - RNA, 19 nt, Artificial Sequence
  Description of Artificial Sequence: Synthetic oligonucleotide
uccagcuuugccugucaau

SEQ ID NO: 1911 - RNA, 19 nt, Artificial Sequence
  Description of Artificial Sequence: Synthetic oligonucleotide
uugacaggcaaagcuggag

SEQ ID NO: 1912 - RNA, 19 nt, Artificial Sequence
  Description of Artificial Sequence: Synthetic oligonucleotide
cuccagcuuugccugucaa

SEQ ID NO: 1913 - RNA, 19 nt, Artificial Sequence
  Description of Artificial Sequence: Synthetic oligonucleotide
gcucggcucucuugaagcu

SEQ ID NO: 1914 - RNA, 19 nt, Artificial Sequence
  Description of Artificial Sequence: Synthetic oligonucleotide
agcuucaagagagccgagc

SEQ ID NO: 1915 - RNA, 19 nt, Artificial Sequence
  Description of Artificial Sequence: Synthetic oligonucleotide
ucggcucucuugaagcugg

SEQ ID NO: 1916 - RNA, 19 nt, Artificial Sequence
  Description of Artificial Sequence: Synthetic oligonucleotide
ccagcuucaagagagccga

SEQ ID NO: 1917 - RNA, 19 nt, Artificial Sequence
  Description of Artificial Sequence: Synthetic oligonucleotide
cggcucucuugaagcuggc

SEQ ID NO: 1918 - RNA, 19 nt, Artificial Sequence
  Description of Artificial Sequence: Synthetic oligonucleotide
gccagcuucaagagagccg

SEQ ID NO: 1919 - RNA, 19 nt, Artificial Sequence
  Description of Artificial Sequence: Synthetic oligonucleotide
ggcucucuugaagcuggcc

SEQ ID NO: 1920 - RNA, 19 nt, Artificial Sequence
  Description of Artificial Sequence: Synthetic oligonucleotide
ggccagcuucaagagagcc

SEQ ID NO: 1921 - RNA, 19 nt, Artificial Sequence
  Description of Artificial Sequence: Synthetic oligonucleotide
gcucucuugaagcuggccu

SEQ ID NO: 1922 - RNA, 19 nt, Artificial Sequence
  Description of Artificial Sequence: Synthetic oligonucleotide
aggccagcuucaagagagc

SEQ ID NO: 1923 - RNA, 19 nt, Artificial Sequence
  Description of Artificial Sequence: Synthetic oligonucleotide
cucucuugaagcuggccug

SEQ ID NO: 1924 - RNA, 19 nt, Artificial Sequence
  Description of Artificial Sequence: Synthetic oligonucleotide
caggccagcuucaagagag

SEQ ID NO: 1925 - RNA, 19 nt, Artificial Sequence
  Description of Artificial Sequence: Synthetic oligonucleotide
ucucuugaagcuggccugu

SEQ ID NO: 1926 - RNA, 19 nt, Artificial Sequence
  Description of Artificial Sequence: Synthetic oligonucleotide
acaggccagcuucaagaga

SEQ ID NO: 1927 - RNA, 19 nt, Artificial Sequence
  Description of Artificial Sequence: Synthetic oligonucleotide
agcuggccugugaccugaa

SEQ ID NO: 1928 - RNA, 19 nt, Artificial Sequence
  Description of Artificial Sequence: Synthetic oligonucleotide
uucaggucacaggccagcu

SEQ ID NO: 1929 - RNA, 19 nt, Artificial Sequence
  Description of Artificial Sequence: Synthetic oligonucleotide
agauuguguauucuguggg

SEQ ID NO: 1930 - RNA, 19 nt, Artificial Sequence
  Description of Artificial Sequence: Synthetic oligonucleotide
cccacagaauacacaaucu

SEQ ID NO: 1931 - RNA, 19 nt, Artificial Sequence
  Description of Artificial Sequence: Synthetic oligonucleotide
cagcaggauggaauuaccu

SEQ ID NO: 1932 - RNA, 19 nt, Artificial Sequence
  Description of Artificial Sequence: Synthetic oligonucleotide
agguaauuccauccugcug

SEQ ID NO: 1933 - RNA, 19 nt, Artificial Sequence
  Description of Artificial Sequence: Synthetic oligonucleotide
caggauggaauuaccuuuu

SEQ ID NO: 1934 - RNA, 19 nt, Artificial Sequence
  Description of Artificial Sequence: Synthetic oligonucleotide
aaaagguaauuccauccug

SEQ ID NO: 1935 - RNA, 19 nt, Artificial Sequence
  Description of Artificial Sequence: Synthetic oligonucleotide
aggauggaauuaccuuuua

SEQ ID NO: 1936 - RNA, 19 nt, Artificial Sequence
  Description of Artificial Sequence: Synthetic oligonucleotide
uaaaagguaauuccauccu

SEQ ID NO: 1937 - RNA, 19 nt, Artificial Sequence
  Description of Artificial Sequence: Synthetic oligonucleotide
ggauggaauuaccuuuuag

SEQ ID NO: 1938 - RNA, 19 nt, Artificial Sequence
  Description of Artificial Sequence: Synthetic oligonucleotide
cuaaaagguaauuccaucc

SEQ ID NO: 1939 - RNA, 19 nt, Artificial Sequence
  Description of Artificial Sequence: Synthetic oligonucleotide
gauggaauuaccuuuuaga

SEQ ID NO: 1940 - RNA, 19 nt, Artificial Sequence
  Description of Artificial Sequence: Synthetic oligonucleotide
ucuaaaagguaauuccauc

SEQ ID NO: 1941 - RNA, 19 nt, Artificial Sequence
  Description of Artificial Sequence: Synthetic oligonucleotide
auggaauuaccuuuuagag

SEQ ID NO: 1942 - RNA, 19 nt, Artificial Sequence
  Description of Artificial Sequence: Synthetic oligonucleotide
cucuaaaagguaauuccau

SEQ ID NO: 1943 - RNA, 19 nt, Artificial Sequence
  Description of Artificial Sequence: Synthetic oligonucleotide
ggaauuaccuuuuagagca

SEQ ID NO: 1944 - RNA, 19 nt, Artificial Sequence
  Description of Artificial Sequence: Synthetic oligonucleotide
ugcucuaaaagguaauucc

SEQ ID NO: 1945 - RNA, 19 nt, Artificial Sequence
  Description of Artificial Sequence: Synthetic oligonucleotide
gaauuaccuuuuagagcaa

SEQ ID NO: 1946 - RNA, 19 nt, Artificial Sequence
  Description of Artificial Sequence: Synthetic oligonucleotide
uugcucuaaaagguaauuc

SEQ ID NO: 1947 - RNA, 19 nt, Artificial Sequence
  Description of Artificial Sequence: Synthetic oligonucleotide
accuuuuagagcaauauga

SEQ ID NO: 1948 - RNA, 19 nt, Artificial Sequence
  Description of Artificial Sequence: Synthetic oligonucleotide
ucauauugcucuaaaaggu

SEQ ID NO: 1949 - RNA, 19 nt, Artificial Sequence
  Description of Artificial Sequence: Synthetic oligonucleotide
ccuuuuagagcaauaugaa

SEQ ID NO: 1950 - RNA, 19 nt, Artificial Sequence
  Description of Artificial Sequence: Synthetic oligonucleotide
uucauauugcucuaaaagg

SEQ ID NO: 1951 - RNA, 19 nt, Artificial Sequence
  Description of Artificial Sequence: Synthetic oligonucleotide
aacugucaaugucaagugc

SEQ ID NO: 1952 - RNA, 19 nt, Artificial Sequence
  Description of Artificial Sequence: Synthetic oligonucleotide
gcacuugacauugacaguu

SEQ ID NO: 1953 - RNA, 19 nt, Artificial Sequence
  Description of Artificial Sequence: Synthetic oligonucleotide
acugucaaugucaagugcu

SEQ ID NO: 1954 - RNA, 19 nt, Artificial Sequence
  Description of Artificial Sequence: Synthetic oligonucleotide
agcacuugacauugacagu

SEQ ID NO: 1955 - RNA, 19 nt, Artificial Sequence
  Description of Artificial Sequence: Synthetic oligonucleotide
aauucuguaugcuuuguca

SEQ ID NO: 1956 - RNA, 19 nt, Artificial Sequence
  Description of Artificial Sequence: Synthetic oligonucleotide
ugacaaagcauacagaauu

SEQ ID NO: 1957 - RNA, 19 nt, Artificial Sequence
  Description of Artificial Sequence: Synthetic oligonucleotide
cuguaugcuuugucaacga

SEQ ID NO: 1958 - RNA, 19 nt, Artificial Sequence
  Description of Artificial Sequence: Synthetic oligonucleotide
ucguugacaaagcauacag

SEQ ID NO: 1959 - RNA, 19 nt, Artificial Sequence
  Description of Artificial Sequence: Synthetic oligonucleotide
uguaugcuuugucaacgag

SEQ ID NO: 1960 - RNA, 19 nt, Artificial Sequence
  Description of Artificial Sequence: Synthetic oligonucleotide
cucguugacaaagcauaca

SEQ ID NO: 1961 - RNA, 19 nt, Artificial Sequence
  Description of Artificial Sequence: Synthetic oligonucleotide
guaugcuuugucaacgagc

SEQ ID NO: 1962 - RNA, 19 nt, Artificial Sequence
  Description of Artificial Sequence: Synthetic oligonucleotide
gcucguugacaaagcauac

SEQ ID NO: 1963 - RNA, 19 nt, Artificial Sequence
  Description of Artificial Sequence: Synthetic oligonucleotide
cuuugucaacgagcaagca

SEQ ID NO: 1964 - RNA, 19 nt, Artificial Sequence
  Description of Artificial Sequence: Synthetic oligonucleotide
ugcuugcucguugacaaag

SEQ ID NO: 1965 - RNA, 19 nt, Artificial Sequence
  Description of Artificial Sequence: Synthetic oligonucleotide
uuugucaacgagcaagcau

SEQ ID NO: 1966 - RNA, 19 nt, Artificial Sequence
  Description of Artificial Sequence: Synthetic oligonucleotide
augcuugcucguugacaaa

SEQ ID NO: 1967 - RNA, 19 nt, Artificial Sequence
  Description of Artificial Sequence: Synthetic oligonucleotide
uugucaacgagcaagcauc

SEQ ID NO: 1968 - RNA, 19 nt, Artificial Sequence
  Description of Artificial Sequence: Synthetic oligonucleotide
gaugcuugcucguugacaa

SEQ ID NO: 1969 - RNA, 19 nt, Artificial Sequence
  Description of Artificial Sequence: Synthetic oligonucleotide
ugucaacgagcaagcauca

SEQ ID NO: 1970 - RNA, 19 nt, Artificial Sequence
  Description of Artificial Sequence: Synthetic oligonucleotide
ugaugcuugcucguugaca

SEQ ID NO: 1971 - RNA, 19 nt, Artificial Sequence
  Description of Artificial Sequence: Synthetic oligonucleotide
aacuuggcagcucuccuuc

SEQ ID NO: 1972 - RNA, 19 nt, Artificial Sequence
  Description of Artificial Sequence: Synthetic oligonucleotide
gaaggagagcugccaaguu

SEQ ID NO: 1973 - RNA, 19 nt, Artificial Sequence
  Description of Artificial Sequence: Synthetic oligonucleotide
cuuggcagcucuccuucau

SEQ ID NO: 1974 - RNA, 19 nt, Artificial Sequence
  Description of Artificial Sequence: Synthetic oligonucleotide
augaaggagagcugccaag

SEQ ID NO: 1975 - RNA, 19 nt, Artificial Sequence
  Description of Artificial Sequence: Synthetic oligonucleotide
uuggcagcucuccuucaug

SEQ ID NO: 1976 - RNA, 19 nt, Artificial Sequence
  Description of Artificial Sequence: Synthetic oligonucleotide
caugaaggagagcugccaa

SEQ ID NO: 1977 - RNA, 19 nt, Artificial Sequence
  Description of Artificial Sequence: Synthetic oligonucleotide
uggcagcucuccuucaugc

SEQ ID NO: 1978 - RNA, 19 nt, Artificial Sequence
  Description of Artificial Sequence: Synthetic oligonucleotide
gcaugaaggagagcugcca

SEQ ID NO: 1979 - RNA, 19 nt, Artificial Sequence
  Description of Artificial Sequence: Synthetic oligonucleotide
ggcagcucuccuucaugcg

SEQ ID NO: 1980 - RNA, 19 nt, Artificial Sequence
  Description of Artificial Sequence: Synthetic oligonucleotide
cgcaugaaggagagcugcc

SEQ ID NO: 1981 - RNA, 19 nt, Artificial Sequence
  Description of Artificial Sequence: Synthetic oligonucleotide
gcagcucuccuucaugcga

SEQ ID NO: 1982 - RNA, 19 nt, Artificial Sequence
  Description of Artificial Sequence: Synthetic oligonucleotide
ucgcaugaaggagagcugc

SEQ ID NO: 1983 - RNA, 19 nt, Artificial Sequence
  Description of Artificial Sequence: Synthetic oligonucleotide
cagcucuccuucaugcgau

SEQ ID NO: 1984 - RNA, 19 nt, Artificial Sequence
  Description of Artificial Sequence: Synthetic oligonucleotide
aucgcaugaaggagagcug

SEQ ID NO: 1985 - RNA, 19 nt, Artificial Sequence
  Description of Artificial Sequence: Synthetic oligonucleotide
agcucuccuucaugcgauu

SEQ ID NO: 1986 - RNA, 19 nt, Artificial Sequence
  Description of Artificial Sequence: Synthetic oligonucleotide
aaucgcaugaaggagagcu

SEQ ID NO: 1987 - RNA, 19 nt, Artificial Sequence
  Description of Artificial Sequence: Synthetic oligonucleotide
gcucuccuucaugcgauug

SEQ ID NO: 1988 - RNA, 19 nt, Artificial Sequence
  Description of Artificial Sequence: Synthetic oligonucleotide
caaucgcaugaaggagagc

SEQ ID NO: 1989 - RNA, 19 nt, Artificial Sequence
  Description of Artificial Sequence: Synthetic oligonucleotide
cucuccuucaugcgauugc

SEQ ID NO: 1990 - RNA, 19 nt, Artificial Sequence
  Description of Artificial Sequence: Synthetic oligonucleotide
gcaaucgcaugaaggagag

SEQ ID NO: 1991 - RNA, 19 nt, Artificial Sequence
  Description of Artificial Sequence: Synthetic oligonucleotide
ucuccuucaugcgauugcc

SEQ ID NO: 1992 - RNA, 19 nt, Artificial Sequence
  Description of Artificial Sequence: Synthetic oligonucleotide
ggcaaucgcaugaaggaga

SEQ ID NO: 1993 - RNA, 19 nt, Artificial Sequence
  Description of Artificial Sequence: Synthetic oligonucleotide
cuccuucaugcgauugcca

SEQ ID NO: 1994 - RNA, 19 nt, Artificial Sequence
  Description of Artificial Sequence: Synthetic oligonucleotide
uggcaaucgcaugaaggag

SEQ ID NO: 1995 - RNA, 19 nt, Artificial Sequence
  Description of Artificial Sequence: Synthetic oligonucleotide
uccuucaugcgauugccag

SEQ ID NO: 1996 - RNA, 19 nt, Artificial Sequence
  Description of Artificial Sequence: Synthetic oligonucleotide
cuggcaaucgcaugaagga

SEQ ID NO: 1997 - RNA, 19 nt, Artificial Sequence
  Description of Artificial Sequence: Synthetic oligonucleotide
ccuucaugcgauugccaga

SEQ ID NO: 1998 - RNA, 19 nt, Artificial Sequence
  Description of Artificial Sequence: Synthetic oligonucleotide
ucuggcaaucgcaugaagg

SEQ ID NO: 1999 - RNA, 19 nt, Artificial Sequence
  Description of Artificial Sequence: Synthetic oligonucleotide
cuucaugcgauugccagac

SEQ ID NO: 2000 - RNA, 19 nt, Artificial Sequence
  Description of Artificial Sequence: Synthetic oligonucleotide
gucuggcaaucgcaugaag

SEQ ID NO: 2001 - RNA, 19 nt, Artificial Sequence
  Description of Artificial Sequence: Synthetic oligonucleotide
uucaugcgauugccagacg

SEQ ID NO: 2002 - RNA, 19 nt, Artificial Sequence
  Description of Artificial Sequence: Synthetic oligonucleotide
cgucuggcaaucgcaugaa

SEQ ID NO: 2003 - RNA, 19 nt, Artificial Sequence
  Description of Artificial Sequence: Synthetic oligonucleotide
ucaugcgauugccagacgu

SEQ ID NO: 2004 - RNA, 19 nt, Artificial Sequence
  Description of Artificial Sequence: Synthetic oligonucleotide
acgucuggcaaucgcauga

SEQ ID NO: 2005 - RNA, 19 nt, Artificial Sequence
  Description of Artificial Sequence: Synthetic oligonucleotide
caugcgauugccagacguc

SEQ ID NO: 2006 - RNA, 19 nt, Artificial Sequence
  Description of Artificial Sequence: Synthetic oligonucleotide
gacgucuggcaaucgcaug

SEQ ID NO: 2007 - RNA, 19 nt, Artificial Sequence
  Description of Artificial Sequence: Synthetic oligonucleotide
augcgauugccagacgucc

SEQ ID NO: 2008 - RNA, 19 nt, Artificial Sequence
  Description of Artificial Sequence: Synthetic oligonucleotide
ggacgucuggcaaucgcau

SEQ ID NO: 2009 - RNA, 19 nt, Artificial Sequence
  Description of Artificial Sequence: Synthetic oligonucleotide
ugcgauugccagacgucca

SEQ ID NO: 2010 - RNA, 19 nt, Artificial Sequence
  Description of Artificial Sequence: Synthetic oligonucleotide
uggacgucuggcaaucgca

SEQ ID NO: 2011 - RNA, 19 nt, Artificial Sequence
  Description of Artificial Sequence: Synthetic oligonucleotide
gcgauugccagacguccaa

SEQ ID NO: 2012 - RNA, 19 nt, Artificial Sequence
  Description of Artificial Sequence: Synthetic oligonucleotide
uuggacgucuggcaaucgc

SEQ ID NO: 2013 - RNA, 19 nt, Artificial Sequence
  Description of Artificial Sequence: Synthetic oligonucleotide
cgauugccagacguccaaa

SEQ ID NO: 2014 - RNA, 19 nt, Artificial Sequence
  Description of Artificial Sequence: Synthetic oligonucleotide
uuuggacgucuggcaaucg

SEQ ID NO: 2015 - RNA, 19 nt, Artificial Sequence
  Description of Artificial Sequence: Synthetic oligonucleotide
uagcaugggauuuuguaag

SEQ ID NO: 2016 - RNA, 19 nt, Artificial Sequence
  Description of Artificial Sequence: Synthetic oligonucleotide
cuuacaaaaucccaugcua

SEQ ID NO: 2017 - RNA, 19 nt, Artificial Sequence
  Description of Artificial Sequence: Synthetic oligonucleotide
gcaugggauuuuguaagag

SEQ ID NO: 2018 - RNA, 19 nt, Artificial Sequence
  Description of Artificial Sequence: Synthetic oligonucleotide
cucuuacaaaaucccaugc

SEQ ID NO: 2019 - RNA, 19 nt, Artificial Sequence
  Description of Artificial Sequence: Synthetic oligonucleotide
aaaauuggacccaucuucu

SEQ ID NO: 2020 - RNA, 19 nt, Artificial Sequence
  Description of Artificial Sequence: Synthetic oligonucleotide
agaagauggguccaauuuu

SEQ ID NO: 2021 - RNA, 19 nt, Artificial Sequence
  Description of Artificial Sequence: Synthetic oligonucleotide
aaauuggacccaucuucug

SEQ ID NO: 2022 - RNA, 19 nt, Artificial Sequence
  Description of Artificial Sequence: Synthetic oligonucleotide
cagaagauggguccaauuu

SEQ ID NO: 2023 - RNA, 19 nt, Artificial Sequence
  Description of Artificial Sequence: Synthetic oligonucleotide
aauuggacccaucuucuga

SEQ ID NO: 2024 - RNA, 19 nt, Artificial Sequence
  Description of Artificial Sequence: Synthetic oligonucleotide
ucagaagauggguccaauu

SEQ ID NO: 2025 - RNA, 19 nt, Artificial Sequence
  Description of Artificial Sequence: Synthetic oligonucleotide
auuggacccaucuucugaa

SEQ ID NO: 2026 - RNA, 19 nt, Artificial Sequence
  Description of Artificial Sequence: Synthetic oligonucleotide
uucagaagauggguccaau

SEQ ID NO: 2027 - RNA, 19 nt, Artificial Sequence
  Description of Artificial Sequence: Synthetic oligonucleotide
aaaauuugacuugggcuca

SEQ ID NO: 2028 - RNA, 19 nt, Artificial Sequence
  Description of Artificial Sequence: Synthetic oligonucleotide
ugagcccaagucaaauuuu

SEQ ID NO: 2029 - RNA, 19 nt, Artificial Sequence
  Description of Artificial Sequence: Synthetic oligonucleotide
aaauuugacuugggcucau

SEQ ID NO: 2030 - RNA, 19 nt, Artificial Sequence
  Description of Artificial Sequence: Synthetic oligonucleotide
augagcccaagucaaauuu

SEQ ID NO: 2031 - RNA, 19 nt, Artificial Sequence
  Description of Artificial Sequence: Synthetic oligonucleotide
aauuugacuugggcucaua

SEQ ID NO: 2032 - RNA, 19 nt, Artificial Sequence
  Description of Artificial Sequence: Synthetic oligonucleotide
uaugagcccaagucaaauu

SEQ ID NO: 2033 - RNA, 19 nt, Artificial Sequence
  Description of Artificial Sequence: Synthetic oligonucleotide
auuugacuugggcucauau

SEQ ID NO: 2034 - RNA, 19 nt, Artificial Sequence
  Description of Artificial Sequence: Synthetic oligonucleotide
auaugagcccaagucaaau

SEQ ID NO: 2035 - RNA, 19 nt, Artificial Sequence
  Description of Artificial Sequence: Synthetic oligonucleotide
uuugacuugggcucauaug

SEQ ID NO: 2036 - RNA, 19 nt, Artificial Sequence
  Description of Artificial Sequence: Synthetic oligonucleotide
cauaugagcccaagucaaa

SEQ ID NO: 2037 - RNA, 19 nt, Artificial Sequence
  Description of Artificial Sequence: Synthetic oligonucleotide
uugacuugggcucauauga

SEQ ID NO: 2038 - RNA, 19 nt, Artificial Sequence
  Description of Artificial Sequence: Synthetic oligonucleotide
ucauaugagcccaagucaa

SEQ ID NO: 2039 - RNA, 19 nt, Artificial Sequence
  Description of Artificial Sequence: Synthetic oligonucleotide
ugacuugggcucauaugac

SEQ ID NO: 2040 - RNA, 19 nt, Artificial Sequence
  Description of Artificial Sequence: Synthetic oligonucleotide
gucauaugagcccaaguca

SEQ ID NO: 2041 - RNA, 19 nt, Artificial Sequence
  Description of Artificial Sequence: Synthetic oligonucleotide
gacuugggcucauaugaca

SEQ ID NO: 2042 - RNA, 19 nt, Artificial Sequence
  Description of Artificial Sequence: Synthetic oligonucleotide
ugucauaugagcccaaguc

SEQ ID NO: 2043 - RNA, 19 nt, Artificial Sequence
  Description of Artificial Sequence: Synthetic oligonucleotide
acuugggcucauaugacau

SEQ ID NO: 2044 - RNA, 19 nt, Artificial Sequence
  Description of Artificial Sequence: Synthetic oligonucleotide
augucauaugagcccaagu

SEQ ID NO: 2045 - RNA, 19 nt, Artificial Sequence
  Description of Artificial Sequence: Synthetic oligonucleotide
uugggcucauaugacauaa

SEQ ID NO: 2046 - RNA, 19 nt, Artificial Sequence
  Description of Artificial Sequence: Synthetic oligonucleotide
uuaugucauaugagcccaa

SEQ ID NO: 2047 - RNA, 19 nt, Artificial Sequence
  Description of Artificial Sequence: Synthetic oligonucleotide
ugggcucauaugacauaag

SEQ ID NO: 2048 - RNA, 19 nt, Artificial Sequence
  Description of Artificial Sequence: Synthetic oligonucleotide
cuuaugucauaugagccca

SEQ ID NO: 2049 - RNA, 19 nt, Artificial Sequence
  Description of Artificial Sequence: Synthetic oligonucleotide
gggcucauaugacauaagg

SEQ ID NO: 2050 - RNA, 19 nt, Artificial Sequence
  Description of Artificial Sequence: Synthetic oligonucleotide
ccuuaugucauaugagccc

SEQ ID NO: 2051 - RNA, 19 nt, Artificial Sequence
  Description of Artificial Sequence: Synthetic oligonucleotide
ggcucauaugacauaagga

SEQ ID NO: 2052 - RNA, 19 nt, Artificial Sequence
  Description of Artificial Sequence: Synthetic oligonucleotide
uccuuaugucauaugagcc

SEQ ID NO: 2053 - RNA, 19 nt, Artificial Sequence
  Description of Artificial Sequence: Synthetic oligonucleotide
cauaugacauaaggaugau

SEQ ID NO: 2054 - RNA, 19 nt, Artificial Sequence
  Description of Artificial Sequence: Synthetic oligonucleotide
aucauccuuaugucauaug

SEQ ID NO: 2055 - RNA, 19 nt, Artificial Sequence
  Description of Artificial Sequence: Synthetic oligonucleotide
auaugacauaaggaugauc

SEQ ID NO: 2056 - RNA, 19 nt, Artificial Sequence
  Description of Artificial Sequence: Synthetic oligonucleotide
gaucauccuuaugucauau

SEQ ID NO: 2057 - RNA, 19 nt, Artificial Sequence
  Description of Artificial Sequence: Synthetic oligonucleotide
uaugacauaaggaugauca

SEQ ID NO: 2058 - RNA, 19 nt, Artificial Sequence
  Description of Artificial Sequence: Synthetic oligonucleotide
ugaucauccuuaugucaua

SEQ ID NO: 2059 - RNA, 19 nt, Artificial Sequence
  Description of Artificial Sequence: Synthetic oligonucleotide
agcucacuuuucuuccaag

SEQ ID NO: 2060 - RNA, 19 nt, Artificial Sequence
  Description of Artificial Sequence: Synthetic oligonucleotide
cuuggaagaaaagugagcu

SEQ ID NO: 2061 - RNA, 19 nt, Artificial Sequence
  Description of Artificial Sequence: Synthetic oligonucleotide
cuuuucuuccaaggauaag

SEQ ID NO: 2062 - RNA, 19 nt, Artificial Sequence
  Description of Artificial Sequence: Synthetic oligonucleotide
cuuauccuuggaagaaaag

SEQ ID NO: 2063 - RNA, 19 nt, Artificial Sequence
  Description of Artificial Sequence: Synthetic oligonucleotide
uuucuuccaaggauaaguu

SEQ ID NO: 2064 - RNA, 19 nt, Artificial Sequence
  Description of Artificial Sequence: Synthetic oligonucleotide
aacuuauccuuggaagaaa

SEQ ID NO: 2065 - RNA, 19 nt, Artificial Sequence
  Description of Artificial Sequence: Synthetic oligonucleotide
uucuuccaaggauaaguug

SEQ ID NO: 2066 - RNA, 19 nt, Artificial Sequence
  Description of Artificial Sequence: Synthetic oligonucleotide
caacuuauccuuggaagaa

SEQ ID NO: 2067 - RNA, 19 nt, Artificial Sequence
  Description of Artificial Sequence: Synthetic oligonucleotide
ucuuccaaggauaaguugc

SEQ ID NO: 2068 - RNA, 19 nt, Artificial Sequence
  Description of Artificial Sequence: Synthetic oligonucleotide
gcaacuuauccuuggaaga

SEQ ID NO: 2069 - RNA, 19 nt, Artificial Sequence
  Description of Artificial Sequence: Synthetic oligonucleotide
cuuccaaggauaaguugca

SEQ ID NO: 2070 - RNA, 19 nt, Artificial Sequence
  Description of Artificial Sequence: Synthetic oligonucleotide
ugcaacuuauccuuggaag

SEQ ID NO: 2071 - RNA, 19 nt, Artificial Sequence
  Description of Artificial Sequence: Synthetic oligonucleotide
uuccaaggauaaguugcaa

SEQ ID NO: 2072 - RNA, 19 nt, Artificial Sequence
  Description of Artificial Sequence: Synthetic oligonucleotide
uugcaacuuauccuuggaa

SEQ ID NO: 2073 - RNA, 19 nt, Artificial Sequence
  Description of Artificial Sequence: Synthetic oligonucleotide
uccaaggauaaguugcaag

SEQ ID NO: 2074 - RNA, 19 nt, Artificial Sequence
  Description of Artificial Sequence: Synthetic oligonucleotide
cuugcaacuuauccuugga

SEQ ID NO: 2075 - RNA, 19 nt, Artificial Sequence
  Description of Artificial Sequence: Synthetic oligonucleotide
ccaaggauaaguugcaaga

SEQ ID NO: 2076 - RNA, 19 nt, Artificial Sequence
  Description of Artificial Sequence: Synthetic oligonucleotide
ucuugcaacuuauccuugg

SEQ ID NO: 2077 - RNA, 19 nt, Artificial Sequence
  Description of Artificial Sequence: Synthetic oligonucleotide
caaggauaaguugcaagag

SEQ ID NO: 2078 - RNA, 19 nt, Artificial Sequence
  Description of Artificial Sequence: Synthetic oligonucleotide
cucuugcaacuuauccuug

SEQ ID NO: 2079 - RNA, 19 nt, Artificial Sequence
  Description of Artificial Sequence: Synthetic oligonucleotide
aaggauaaguugcaagagg

SEQ ID NO: 2080 - RNA, 19 nt, Artificial Sequence
  Description of Artificial Sequence: Synthetic oligonucleotide
ccucuugcaacuuauccuu

SEQ ID NO: 2081 - RNA, 19 nt, Artificial Sequence
  Description of Artificial Sequence: Synthetic oligonucleotide
aggauaaguugcaagaggu

SEQ ID NO: 2082 - RNA, 19 nt, Artificial Sequence
  Description of Artificial Sequence: Synthetic oligonucleotide
accucuugcaacuuauccu

SEQ ID NO: 2083 - RNA, 19 nt, Artificial Sequence
  Description of Artificial Sequence: Synthetic oligonucleotide
ggauaaguugcaagaggug

SEQ ID NO: 2084 - RNA, 19 nt, Artificial Sequence
  Description of Artificial Sequence: Synthetic oligonucleotide
caccucuugcaacuuaucc

SEQ ID NO: 2085 - RNA, 19 nt, Artificial Sequence
  Description of Artificial Sequence: Synthetic oligonucleotide
gauaaguugcaagagguga

SEQ ID NO: 2086 - RNA, 19 nt, Artificial Sequence
  Description of Artificial Sequence: Synthetic oligonucleotide
ucaccucuugcaacuuauc

SEQ ID NO: 2087 - RNA, 19 nt, Artificial Sequence
  Description of Artificial Sequence: Synthetic oligonucleotide
auaaguugcaagaggugaa

SEQ ID NO: 2088 - RNA, 19 nt, Artificial Sequence
  Description of Artificial Sequence: Synthetic oligonucleotide
uucaccucuugcaacuuau

SEQ ID NO: 2089 - RNA, 19 nt, Artificial Sequence
  Description of Artificial Sequence: Synthetic oligonucleotide
uuuugaaucucuugaggcu

SEQ ID NO: 2090 - RNA, 19 nt, Artificial Sequence
  Description of Artificial Sequence: Synthetic oligonucleotide
agccucaagagauucaaaa

SEQ ID NO: 2091 - RNA, 19 nt, Artificial Sequence
  Description of Artificial Sequence: Synthetic oligonucleotide
uuugaaucucuugaggcuc

SEQ ID NO: 2092 - RNA, 19 nt, Artificial Sequence
  Description of Artificial Sequence: Synthetic oligonucleotide
gagccucaagagauucaaa

SEQ ID NO: 2093 - RNA, 19 nt, Artificial Sequence
  Description of Artificial Sequence: Synthetic oligonucleotide
uugaaucucuugaggcuca

SEQ ID NO: 2094 - RNA, 19 nt, Artificial Sequence
  Description of Artificial Sequence: Synthetic oligonucleotide
ugagccucaagagauucaa

SEQ ID NO: 2095 - RNA, 19 nt, Artificial Sequence
  Description of Artificial Sequence: Synthetic oligonucleotide
gaggcucaaggaucacauc

SEQ ID NO: 2096 - RNA, 19 nt, Artificial Sequence
  Description of Artificial Sequence: Synthetic oligonucleotide
gaugugauccuugagccuc

SEQ ID NO: 2097 - RNA, 19 nt, Artificial Sequence
  Description of Artificial Sequence: Synthetic oligonucleotide
aggcucaaggaucacaucu

SEQ ID NO: 2098 - RNA, 19 nt, Artificial Sequence
  Description of Artificial Sequence: Synthetic oligonucleotide
agaugugauccuugagccu

SEQ ID NO: 2099 - RNA, 19 nt, Artificial Sequence
  Description of Artificial Sequence: Synthetic oligonucleotide
ggcucaaggaucacaucug

SEQ ID NO: 2100 - RNA, 19 nt, Artificial Sequence
  Description of Artificial Sequence: Synthetic oligonucleotide
cagaugugauccuugagcc

SEQ ID NO: 2101 - RNA, 19 nt, Artificial Sequence
  Description of Artificial Sequence: Synthetic oligonucleotide
aggaucacaucuggauauu

SEQ ID NO: 2102 - RNA, 19 nt, Artificial Sequence
  Description of Artificial Sequence: Synthetic oligonucleotide
aauauccagaugugauccu

SEQ ID NO: 2103 - RNA, 19 nt, Artificial Sequence
  Description of Artificial Sequence: Synthetic oligonucleotide
gaucacaucuggauauuuu

SEQ ID NO: 2104 - RNA, 19 nt, Artificial Sequence
  Description of Artificial Sequence: Synthetic oligonucleotide
aaaauauccagaugugauc

SEQ ID NO: 2105 - RNA, 19 nt, Artificial Sequence
  Description of Artificial Sequence: Synthetic oligonucleotide
aaauauaaaauggcuggag

SEQ ID NO: 2106 - RNA, 19 nt, Artificial Sequence
  Description of Artificial Sequence: Synthetic oligonucleotide
cuccagccauuuuauauuu

SEQ ID NO: 2107 - RNA, 19 nt, Artificial Sequence
  Description of Artificial Sequence: Synthetic oligonucleotide
gaggacuuggcuaaugguu

SEQ ID NO: 2108 - RNA, 19 nt, Artificial Sequence
  Description of Artificial Sequence: Synthetic oligonucleotide
aaccauuagccaaguccuc

SEQ ID NO: 2109 - RNA, 19 nt, Artificial Sequence
  Description of Artificial Sequence: Synthetic oligonucleotide
aggacuuggcuaaugguua

SEQ ID NO: 2110 - RNA, 19 nt, Artificial Sequence
  Description of Artificial Sequence: Synthetic oligonucleotide
uaaccauuagccaaguccu

SEQ ID NO: 2111 - RNA, 19 nt, Artificial Sequence
  Description of Artificial Sequence: Synthetic oligonucleotide
ggacuuggcuaaugguuaa

SEQ ID NO: 2112 - RNA, 19 nt, Artificial Sequence
  Description of Artificial Sequence: Synthetic oligonucleotide
uuaaccauuagccaagucc

SEQ ID NO: 2113 - RNA, 19 nt, Artificial Sequence
  Description of Artificial Sequence: Synthetic oligonucleotide
gacuuggcuaaugguuaau

SEQ ID NO: 2114 - RNA, 19 nt, Artificial Sequence
  Description of Artificial Sequence: Synthetic oligonucleotide
auuaaccauuagccaaguc

SEQ ID NO: 2115 - RNA, 19 nt, Artificial Sequence
  Description of Artificial Sequence: Synthetic oligonucleotide
acuuggcuaaugguuaaua

SEQ ID NO: 2116 - RNA, 19 nt, Artificial Sequence
  Description of Artificial Sequence: Synthetic oligonucleotide
uauuaaccauuagccaagu

SEQ ID NO: 2117 - RNA, 19 nt, Artificial Sequence
  Description of Artificial Sequence: Synthetic oligonucleotide
cuuggcuaaugguuaauac

SEQ ID NO: 2118 - RNA, 19 nt, Artificial Sequence
  Description of Artificial Sequence: Synthetic oligonucleotide
guauuaaccauuagccaag

SEQ ID NO: 2119 - RNA, 19 nt, Artificial Sequence
  Description of Artificial Sequence: Synthetic oligonucleotide
uuggcuaaugguuaauacu

SEQ ID NO: 2120 - RNA, 19 nt, Artificial Sequence
  Description of Artificial Sequence: Synthetic oligonucleotide
aguauuaaccauuagccaa

SEQ ID NO: 2121 - RNA, 19 nt, Artificial Sequence
  Description of Artificial Sequence: Synthetic oligonucleotide
uggcuaaugguuaauacuu

SEQ ID NO: 2122 - RNA, 19 nt, Artificial Sequence
  Description of Artificial Sequence: Synthetic oligonucleotide
aaguauuaaccauuagcca

SEQ ID NO: 2123 - RNA, 19 nt, Artificial Sequence
  Description of Artificial Sequence: Synthetic oligonucleotide
cgguggcucacgccuguaa

SEQ ID NO: 2124 - RNA, 19 nt, Artificial Sequence
  Description of Artificial Sequence: Synthetic oligonucleotide
uuacaggcgugagccaccg

SEQ ID NO: 2125 - RNA, 19 nt, Artificial Sequence
  Description of Artificial Sequence: Synthetic oligonucleotide
gguggcucacgccuguaau

SEQ ID NO: 2126 - RNA, 19 nt, Artificial Sequence
  Description of Artificial Sequence: Synthetic oligonucleotide
auuacaggcgugagccacc

SEQ ID NO: 2127 - RNA, 19 nt, Artificial Sequence
  Description of Artificial Sequence: Synthetic oligonucleotide
guggcucacgccuguaauc

SEQ ID NO: 2128 - RNA, 19 nt, Artificial Sequence
  Description of Artificial Sequence: Synthetic oligonucleotide
gauuacaggcgugagccac

SEQ ID NO: 2129 - RNA, 19 nt, Artificial Sequence
  Description of Artificial Sequence: Synthetic oligonucleotide
uggcucacgccuguaaucc

SEQ ID NO: 2130 - RNA, 19 nt, Artificial Sequence
  Description of Artificial Sequence: Synthetic oligonucleotide
ggauuacaggcgugagcca

SEQ ID NO: 2131 - RNA, 19 nt, Artificial Sequence
  Description of Artificial Sequence: Synthetic oligonucleotide
ggcucacgccuguaauccc

SEQ ID NO: 2132 - RNA, 19 nt, Artificial Sequence
  Description of Artificial Sequence: Synthetic oligonucleotide
gggauuacaggcgugagcc

SEQ ID NO: 2133 - RNA, 19 nt, Artificial Sequence
  Description of Artificial Sequence: Synthetic oligonucleotide
acgccuguaaucccagcac

SEQ ID NO: 2134 - RNA, 19 nt, Artificial Sequence
  Description of Artificial Sequence: Synthetic oligonucleotide
gugcugggauuacaggcgu

SEQ ID NO: 2135 - RNA, 19 nt, Artificial Sequence
  Description of Artificial Sequence: Synthetic oligonucleotide
agcacuuugggaggcugag

SEQ ID NO: 2136 - RNA, 19 nt, Artificial Sequence
  Description of Artificial Sequence: Synthetic oligonucleotide
cucagccucccaaagugcu

SEQ ID NO: 2137 - RNA, 19 nt, Artificial Sequence
  Description of Artificial Sequence: Synthetic oligonucleotide
caugguggcaggugccugu

SEQ ID NO: 2138 - RNA, 19 nt, Artificial Sequence
  Description of Artificial Sequence: Synthetic oligonucleotide
acaggcaccugccaccaug

SEQ ID NO: 2139 - RNA, 19 nt, Artificial Sequence
  Description of Artificial Sequence: Synthetic oligonucleotide
augguggcaggugccugua

SEQ ID NO: 2140 - RNA, 19 nt, Artificial Sequence
  Description of Artificial Sequence: Synthetic oligonucleotide
uacaggcaccugccaccau

SEQ ID NO: 2141 - RNA, 19 nt, Artificial Sequence
  Description of Artificial Sequence: Synthetic oligonucleotide
uggcaggugccuguagucc

SEQ ID NO: 2142 - RNA, 19 nt, Artificial Sequence
  Description of Artificial Sequence: Synthetic oligonucleotide
ggacuacaggcaccugcca

SEQ ID NO: 2143 - RNA, 19 nt, Artificial Sequence
  Description of Artificial Sequence: Synthetic oligonucleotide
gcaggugccuguaguccca

SEQ ID NO: 2144 - RNA, 19 nt, Artificial Sequence
  Description of Artificial Sequence: Synthetic oligonucleotide
ugggacuacaggcaccugc

SEQ ID NO: 2145 - RNA, 19 nt, Artificial Sequence
  Description of Artificial Sequence: Synthetic oligonucleotide
gugccuguagucccagcua

SEQ ID NO: 2146 - RNA, 19 nt, Artificial Sequence
  Description of Artificial Sequence: Synthetic oligonucleotide
uagcugggacuacaggcac

SEQ ID NO: 2147 - RNA, 19 nt, Artificial Sequence
  Description of Artificial Sequence: Synthetic oligonucleotide
uagucccagcuacucggca

SEQ ID NO: 2148 - RNA, 19 nt, Artificial Sequence
  Description of Artificial Sequence: Synthetic oligonucleotide
ugccgaguagcugggacua

SEQ ID NO: 2149 - RNA, 19 nt, Artificial Sequence
  Description of Artificial Sequence: Synthetic oligonucleotide
agucccagcuacucggcag

SEQ ID NO: 2150 - RNA, 19 nt, Artificial Sequence
  Description of Artificial Sequence: Synthetic oligonucleotide
cugccgaguagcugggacu

SEQ ID NO: 2151 - RNA, 19 nt, Artificial Sequence
  Description of Artificial Sequence: Synthetic oligonucleotide
gagcuugcagugagccgag

SEQ ID NO: 2152 - RNA, 19 nt, Artificial Sequence
  Description of Artificial Sequence: Synthetic oligonucleotide
cucggcucacugcaagcuc

SEQ ID NO: 2153 - RNA, 19 nt, Artificial Sequence
  Description of Artificial Sequence: Synthetic oligonucleotide
acugcauuccagccugggu

SEQ ID NO: 2154 - RNA, 19 nt, Artificial Sequence
  Description of Artificial Sequence: Synthetic oligonucleotide
acccaggcuggaaugcagu

SEQ ID NO: 2155 - RNA, 19 nt, Artificial Sequence
  Description of Artificial Sequence: Synthetic oligonucleotide
cugcauuccagccugggug

SEQ ID NO: 2156 - RNA, 19 nt, Artificial Sequence
  Description of Artificial Sequence: Synthetic oligonucleotide
cacccaggcuggaaugcag

SEQ ID NO: 2157 - RNA, 19 nt, Artificial Sequence
  Description of Artificial Sequence: Synthetic oligonucleotide
ugcauuccagccuggguga

SEQ ID NO: 2158 - RNA, 19 nt, Artificial Sequence
  Description of Artificial Sequence: Synthetic oligonucleotide
ucacccaggcuggaaugca

SEQ ID NO: 2159 - RNA, 19 nt, Artificial Sequence
  Description of Artificial Sequence: Synthetic oligonucleotide
gcauuccagccugggugac

SEQ ID NO: 2160 - RNA, 19 nt, Artificial Sequence
  Description of Artificial Sequence: Synthetic oligonucleotide
gucacccaggcuggaaugc

SEQ ID NO: 2161 - RNA, 19 nt, Artificial Sequence
  Description of Artificial Sequence: Synthetic oligonucleotide
cauuccagccugggugacu

SEQ ID NO: 2162 - RNA, 19 nt, Artificial Sequence
  Description of Artificial Sequence: Synthetic oligonucleotide
agucacccaggcuggaaug

SEQ ID NO: 2163 - RNA, 19 nt, Artificial Sequence
  Description of Artificial Sequence: Synthetic oligonucleotide
auuccagccugggugacug

SEQ ID NO: 2164 - RNA, 19 nt, Artificial Sequence
  Description of Artificial Sequence: Synthetic oligonucleotide
cagucacccaggcuggaau

SEQ ID NO: 2165 - RNA, 19 nt, Artificial Sequence
  Description of Artificial Sequence: Synthetic oligonucleotide
uuccagccugggugacuga

SEQ ID NO: 2166 - RNA, 19 nt, Artificial Sequence
  Description of Artificial Sequence: Synthetic oligonucleotide
ucagucacccaggcuggaa

SEQ ID NO: 2167 - RNA, 19 nt, Artificial Sequence
  Description of Artificial Sequence: Synthetic oligonucleotide
uccagccugggugacugag

SEQ ID NO: 2168 - RNA, 19 nt, Artificial Sequence
  Description of Artificial Sequence: Synthetic oligonucleotide
cucagucacccaggcugga

SEQ ID NO: 2169 - RNA, 19 nt, Artificial Sequence
  Description of Artificial Sequence: Synthetic oligonucleotide
aagguacaucagacaugac

SEQ ID NO: 2170 - RNA, 19 nt, Artificial Sequence
  Description of Artificial Sequence: Synthetic oligonucleotide
gucaugucugauguaccuu

SEQ ID NO: 2171 - RNA, 19 nt, Artificial Sequence
  Description of Artificial Sequence: Synthetic oligonucleotide
agguacaucagacaugacu

SEQ ID NO: 2172 - RNA, 19 nt, Artificial Sequence
  Description of Artificial Sequence: Synthetic oligonucleotide
agucaugucugauguaccu

SEQ ID NO: 2173 - RNA, 19 nt, Artificial Sequence
  Description of Artificial Sequence: Synthetic oligonucleotide
gguacaucagacaugacug

SEQ ID NO: 2174 - RNA, 19 nt, Artificial Sequence
  Description of Artificial Sequence: Synthetic oligonucleotide
cagucaugucugauguacc

SEQ ID NO: 2175 - RNA, 19 nt, Artificial Sequence
  Description of Artificial Sequence: Synthetic oligonucleotide
guacaucagacaugacugc

SEQ ID NO: 2176 - RNA, 19 nt, Artificial Sequence
  Description of Artificial Sequence: Synthetic oligonucleotide
gcagucaugucugauguac

SEQ ID NO: 2177 - RNA, 19 nt, Artificial Sequence
  Description of Artificial Sequence: Synthetic oligonucleotide
aucagacaugacugccugc

SEQ ID NO: 2178 - RNA, 19 nt, Artificial Sequence
  Description of Artificial Sequence: Synthetic oligonucleotide
gcaggcagucaugucugau

SEQ ID NO: 2179 - RNA, 19 nt, Artificial Sequence
  Description of Artificial Sequence: Synthetic oligonucleotide
ucagacaugacugccugca

SEQ ID NO: 2180 - RNA, 19 nt, Artificial Sequence
  Description of Artificial Sequence: Synthetic oligonucleotide
ugcaggcagucaugucuga

SEQ ID NO: 2181 - RNA, 19 nt, Artificial Sequence
  Description of Artificial Sequence: Synthetic oligonucleotide
cagacaugacugccugcau

SEQ ID NO: 2182 - RNA, 19 nt, Artificial Sequence
  Description of Artificial Sequence: Synthetic oligonucleotide
augcaggcagucaugucug

SEQ ID NO: 2183 - RNA, 19 nt, Artificial Sequence
  Description of Artificial Sequence: Synthetic oligonucleotide
augacugccugcaugaagu

SEQ ID NO: 2184 - RNA, 19 nt, Artificial Sequence
  Description of Artificial Sequence: Synthetic oligonucleotide
acuucaugcaggcagucau

SEQ ID NO: 2185 - RNA, 19 nt, Artificial Sequence
  Description of Artificial Sequence: Synthetic oligonucleotide
acugccugcaugaagucaa

SEQ ID NO: 2186 - RNA, 19 nt, Artificial Sequence
  Description of Artificial Sequence: Synthetic oligonucleotide
uugacuucaugcaggcagu

SEQ ID NO: 2187 - RNA, 19 nt, Artificial Sequence
  Description of Artificial Sequence: Synthetic oligonucleotide
cugccugcaugaagucaaa

SEQ ID NO: 2188 - RNA, 19 nt, Artificial Sequence
  Description of Artificial Sequence: Synthetic oligonucleotide
uuugacuucaugcaggcag

SEQ ID NO: 2189 - RNA, 19 nt, Artificial Sequence
  Description of Artificial Sequence: Synthetic oligonucleotide
acaccagugaagcucaagu

SEQ ID NO: 2190 - RNA, 19 nt, Artificial Sequence
  Description of Artificial Sequence: Synthetic oligonucleotide
acuugagcuucacuggugu

SEQ ID NO: 2191 - RNA, 19 nt, Artificial Sequence
  Description of Artificial Sequence: Synthetic oligonucleotide
caccagugaagcucaaguc

SEQ ID NO: 2192 - RNA, 19 nt, Artificial Sequence
  Description of Artificial Sequence: Synthetic oligonucleotide
gacuugagcuucacuggug

SEQ ID NO: 2193 - RNA, 19 nt, Artificial Sequence
  Description of Artificial Sequence: Synthetic oligonucleotide
accagugaagcucaaguca

SEQ ID NO: 2194 - RNA, 19 nt, Artificial Sequence
  Description of Artificial Sequence: Synthetic oligonucleotide
ugacuugagcuucacuggu

SEQ ID NO: 2195 - RNA, 19 nt, Artificial Sequence
  Description of Artificial Sequence: Synthetic oligonucleotide
gugaagcucaagucaagag

SEQ ID NO: 2196 - RNA, 19 nt, Artificial Sequence
  Description of Artificial Sequence: Synthetic oligonucleotide
cucuugacuugagcuucac

SEQ ID NO: 2197 - RNA, 19 nt, Artificial Sequence
  Description of Artificial Sequence: Synthetic oligonucleotide
cucaagucaagagcugugg

SEQ ID NO: 2198 - RNA, 19 nt, Artificial Sequence
  Description of Artificial Sequence: Synthetic oligonucleotide
ccacagcucuugacuugag

SEQ ID NO: 2199 - RNA, 19 nt, Artificial Sequence
  Description of Artificial Sequence: Synthetic oligonucleotide
ucaagucaagagcugugga

SEQ ID NO: 2200 - RNA, 19 nt, Artificial Sequence
  Description of Artificial Sequence: Synthetic oligonucleotide
uccacagcucuugacuuga

SEQ ID NO: 2201 - RNA, 19 nt, Artificial Sequence
  Description of Artificial Sequence: Synthetic oligonucleotide
caagucaagagcuguggau

SEQ ID NO: 2202 - RNA, 19 nt, Artificial Sequence
  Description of Artificial Sequence: Synthetic oligonucleotide
auccacagcucuugacuug

SEQ ID NO: 2203 - RNA, 19 nt, Artificial Sequence
  Description of Artificial Sequence: Synthetic oligonucleotide
aagucaagagcuguggaua

SEQ ID NO: 2204 - RNA, 19 nt, Artificial Sequence
  Description of Artificial Sequence: Synthetic oligonucleotide
uauccacagcucuugacuu

SEQ ID NO: 2205 - RNA, 19 nt, Artificial Sequence
  Description of Artificial Sequence: Synthetic oligonucleotide
agucaagagcuguggauau

SEQ ID NO: 2206 - RNA, 19 nt, Artificial Sequence
  Description of Artificial Sequence: Synthetic oligonucleotide
auauccacagcucuugacu

SEQ ID NO: 2207 - RNA, 19 nt, Artificial Sequence
  Description of Artificial Sequence: Synthetic oligonucleotide
gucaagagcuguggauauu

SEQ ID NO: 2208 - RNA, 19 nt, Artificial Sequence
  Description of Artificial Sequence: Synthetic oligonucleotide
aauauccacagcucuugac

SEQ ID NO: 2209 - RNA, 19 nt, Artificial Sequence
  Description of Artificial Sequence: Synthetic oligonucleotide
caagagcuguggauauuuu

SEQ ID NO: 2210 - RNA, 19 nt, Artificial Sequence
  Description of Artificial Sequence: Synthetic oligonucleotide
aaaauauccacagcucuug

SEQ ID NO: 2211 - RNA, 19 nt, Artificial Sequence
  Description of Artificial Sequence: Synthetic oligonucleotide
aagagcuguggauauuuug

SEQ ID NO: 2212 - RNA, 19 nt, Artificial Sequence
  Description of Artificial Sequence: Synthetic oligonucleotide
caaaauauccacagcucuu

SEQ ID NO: 2213 - RNA, 19 nt, Artificial Sequence
  Description of Artificial Sequence: Synthetic oligonucleotide
agagcuguggauauuuugu

SEQ ID NO: 2214 - RNA, 19 nt, Artificial Sequence
  Description of Artificial Sequence: Synthetic oligonucleotide
acaaaauauccacagcucu

SEQ ID NO: 2215 - RNA, 19 nt, Artificial Sequence
  Description of Artificial Sequence: Synthetic oligonucleotide
gagcuguggauauuuuguc

SEQ ID NO: 2216 - RNA, 19 nt, Artificial Sequence
  Description of Artificial Sequence: Synthetic oligonucleotide
gacaaaauauccacagcuc

SEQ ID NO: 2217 - RNA, 19 nt, Artificial Sequence
  Description of Artificial Sequence: Synthetic oligonucleotide
agcuguggauauuuugucu

SEQ ID NO: 2218 - RNA, 19 nt, Artificial Sequence
  Description of Artificial Sequence: Synthetic oligonucleotide
agacaaaauauccacagcu

SEQ ID NO: 2219 - RNA, 19 nt, Artificial Sequence
  Description of Artificial Sequence: Synthetic oligonucleotide
gcuguggauauuuugucua

SEQ ID NO: 2220 - RNA, 19 nt, Artificial Sequence
  Description of Artificial Sequence: Synthetic oligonucleotide
uagacaaaauauccacagc

SEQ ID NO: 2221 - RNA, 19 nt, Artificial Sequence
  Description of Artificial Sequence: Synthetic oligonucleotide
cuguggauauuuugucuaa

SEQ ID NO: 2222 - RNA, 19 nt, Artificial Sequence
  Description of Artificial Sequence: Synthetic oligonucleotide
uuagacaaaauauccacag

SEQ ID NO: 2223 - RNA, 19 nt, Artificial Sequence
  Description of Artificial Sequence: Synthetic oligonucleotide
uguggauauuuugucuaac

SEQ ID NO: 2224 - RNA, 19 nt, Artificial Sequence
  Description of Artificial Sequence: Synthetic oligonucleotide
guuagacaaaauauccaca

SEQ ID NO: 2225 - RNA, 19 nt, Artificial Sequence
  Description of Artificial Sequence: Synthetic oligonucleotide
guggauauuuugucuaacc

SEQ ID NO: 2226 - RNA, 19 nt, Artificial Sequence
  Description of Artificial Sequence: Synthetic oligonucleotide
gguuagacaaaauauccac

SEQ ID NO: 2227 - RNA, 19 nt, Artificial Sequence
  Description of Artificial Sequence: Synthetic oligonucleotide
uggauauuuugucuaacca

SEQ ID NO: 2228 - RNA, 19 nt, Artificial Sequence
  Description of Artificial Sequence: Synthetic oligonucleotide
ugguuagacaaaauaucca

SEQ ID NO: 2229 - RNA, 19 nt, Artificial Sequence
  Description of Artificial Sequence: Synthetic oligonucleotide
ggauauuuugucuaaccaa

SEQ ID NO: 2230 - RNA, 19 nt, Artificial Sequence
  Description of Artificial Sequence: Synthetic oligonucleotide
uugguuagacaaaauaucc

SEQ ID NO: 2231 - RNA, 19 nt, Artificial Sequence
  Description of Artificial Sequence: Synthetic oligonucleotide
ucguauccagccaaaagau

SEQ ID NO: 2232 - RNA, 19 nt, Artificial Sequence
  Description of Artificial Sequence: Synthetic oligonucleotide
aucuuuuggcuggauacga

SEQ ID NO: 2233 - RNA, 19 nt, Artificial Sequence
  Description of Artificial Sequence: Synthetic oligonucleotide
cguauccagccaaaagaug

SEQ ID NO: 2234 - RNA, 19 nt, Artificial Sequence
  Description of Artificial Sequence: Synthetic oligonucleotide
caucuuuuggcuggauacg

SEQ ID NO: 2235 - RNA, 19 nt, Artificial Sequence
  Description of Artificial Sequence: Synthetic oligonucleotide
guauccagccaaaagaugc

SEQ ID NO: 2236 - RNA, 19 nt, Artificial Sequence
  Description of Artificial Sequence: Synthetic oligonucleotide
gcaucuuuuggcuggauac

SEQ ID NO: 2237 - RNA, 19 nt, Artificial Sequence
  Description of Artificial Sequence: Synthetic oligonucleotide
uauccagccaaaagaugca

SEQ ID NO: 2238 - RNA, 19 nt, Artificial Sequence
  Description of Artificial Sequence: Synthetic oligonucleotide
ugcaucuuuuggcuggaua

SEQ ID NO: 2239 - RNA, 19 nt, Artificial Sequence
  Description of Artificial Sequence: Synthetic oligonucleotide
auccagccaaaagaugcau

SEQ ID NO: 2240 - RNA, 19 nt, Artificial Sequence
  Description of Artificial Sequence: Synthetic oligonucleotide
augcaucuuuuggcuggau

SEQ ID NO: 2241 - RNA, 19 nt, Artificial Sequence
  Description of Artificial Sequence: Synthetic oligonucleotide
agccaaaagaugcaugaug

SEQ ID NO: 2242 - RNA, 19 nt, Artificial Sequence
  Description of Artificial Sequence: Synthetic oligonucleotide
caucaugcaucuuuuggcu

SEQ ID NO: 2243 - RNA, 19 nt, Artificial Sequence
  Description of Artificial Sequence: Synthetic oligonucleotide
gccaaaagaugcaugauga

SEQ ID NO: 2244 - RNA, 19 nt, Artificial Sequence
  Description of Artificial Sequence: Synthetic oligonucleotide
ucaucaugcaucuuuuggc

SEQ ID NO: 2245 - RNA, 19 nt, Artificial Sequence
  Description of Artificial Sequence: Synthetic oligonucleotide
ccaaaagaugcaugaugau

SEQ ID NO: 2246 - RNA, 19 nt, Artificial Sequence
  Description of Artificial Sequence: Synthetic oligonucleotide
aucaucaugcaucuuuugg

SEQ ID NO: 2247 - RNA, 19 nt, Artificial Sequence
  Description of Artificial Sequence: Synthetic oligonucleotide
caaaagaugcaugaugaug

SEQ ID NO: 2248 - RNA, 19 nt, Artificial Sequence
  Description of Artificial Sequence: Synthetic oligonucleotide
caucaucaugcaucuuuug

SEQ ID NO: 2249 - RNA, 19 nt, Artificial Sequence
  Description of Artificial Sequence: Synthetic oligonucleotide
aaaagaugcaugaugaugg

SEQ ID NO: 2250 - RNA, 19 nt, Artificial Sequence
  Description of Artificial Sequence: Synthetic oligonucleotide
ccaucaucaugcaucuuuu

SEQ ID NO: 2251 - RNA, 19 nt, Artificial Sequence
  Description of Artificial Sequence: Synthetic oligonucleotide
aaagaugcaugaugaugga

SEQ ID NO: 2252 - RNA, 19 nt, Artificial Sequence
  Description of Artificial Sequence: Synthetic oligonucleotide
uccaucaucaugcaucuuu

SEQ ID NO: 2253 - RNA, 19 nt, Artificial Sequence
  Description of Artificial Sequence: Synthetic oligonucleotide
gcaugaugauggaguggug

SEQ ID NO: 2254 - RNA, 19 nt, Artificial Sequence
  Description of Artificial Sequence: Synthetic oligonucleotide
caccacuccaucaucaugc

SEQ ID NO: 2255 - RNA, 19 nt, Artificial Sequence
  Description of Artificial Sequence: Synthetic oligonucleotide
caugaugauggaguggugg

SEQ ID NO: 2256 - RNA, 19 nt, Artificial Sequence
  Description of Artificial Sequence: Synthetic oligonucleotide
ccaccacuccaucaucaug

SEQ ID NO: 2257 - RNA, 19 nt, Artificial Sequence
  Description of Artificial Sequence: Synthetic oligonucleotide
augaugauggagugguggg

SEQ ID NO: 2258 - RNA, 19 nt, Artificial Sequence
  Description of Artificial Sequence: Synthetic oligonucleotide
cccaccacuccaucaucau

SEQ ID NO: 2259 - RNA, 19 nt, Artificial Sequence
  Description of Artificial Sequence: Synthetic oligonucleotide
gggaaggccaguucaguau

SEQ ID NO: 2260 - RNA, 19 nt, Artificial Sequence
  Description of Artificial Sequence: Synthetic oligonucleotide
auacugaacuggccuuccc

SEQ ID NO: 2261 - RNA, 19 nt, Artificial Sequence
  Description of Artificial Sequence: Synthetic oligonucleotide
ggaaggccaguucaguauc

SEQ ID NO: 2262 - RNA, 19 nt, Artificial Sequence
  Description of Artificial Sequence: Synthetic oligonucleotide
gauacugaacuggccuucc

SEQ ID NO: 2263 - RNA, 19 nt, Artificial Sequence
  Description of Artificial Sequence: Synthetic oligonucleotide
gaaggccaguucaguaucc

SEQ ID NO: 2264 - RNA, 19 nt, Artificial Sequence
  Description of Artificial Sequence: Synthetic oligonucleotide
ggauacugaacuggccuuc

SEQ ID NO: 2265 - RNA, 19 nt, Artificial Sequence
  Description of Artificial Sequence: Synthetic oligonucleotide
aggccaguucaguauccua

SEQ ID NO: 2266 - RNA, 19 nt, Artificial Sequence
  Description of Artificial Sequence: Synthetic oligonucleotide
uaggauacugaacuggccu

SEQ ID NO: 2267 - RNA, 19 nt, Artificial Sequence
  Description of Artificial Sequence: Synthetic oligonucleotide
ggccaguucaguauccuau

SEQ ID NO: 2268 - RNA, 19 nt, Artificial Sequence
  Description of Artificial Sequence: Synthetic oligonucleotide
auaggauacugaacuggcc

SEQ ID NO: 2269 - RNA, 19 nt, Artificial Sequence
  Description of Artificial Sequence: Synthetic oligonucleotide
gccaguucaguauccuauu

SEQ ID NO: 2270 - RNA, 19 nt, Artificial Sequence
  Description of Artificial Sequence: Synthetic oligonucleotide
aauaggauacugaacuggc

SEQ ID NO: 2271 - RNA, 19 nt, Artificial Sequence
  Description of Artificial Sequence: Synthetic oligonucleotide
ccaguucaguauccuauuu

SEQ ID NO: 2272 - RNA, 19 nt, Artificial Sequence
  Description of Artificial Sequence: Synthetic oligonucleotide
aaauaggauacugaacugg

SEQ ID NO: 2273 - RNA, 19 nt, Artificial Sequence
  Description of Artificial Sequence: Synthetic oligonucleotide
caguucaguauccuauuua

SEQ ID NO: 2274 - RNA, 19 nt, Artificial Sequence
  Description of Artificial Sequence: Synthetic oligonucleotide
uaaauaggauacugaacug

SEQ ID NO: 2275 - RNA, 19 nt, Artificial Sequence
  Description of Artificial Sequence: Synthetic oligonucleotide
aacuuccugaauaauggau

SEQ ID NO: 2276 - RNA, 19 nt, Artificial Sequence
  Description of Artificial Sequence: Synthetic oligonucleotide
auccauuauucaggaaguu

SEQ ID NO: 2277 - RNA, 19 nt, Artificial Sequence
  Description of Artificial Sequence: Synthetic oligonucleotide
acuuccugaauaauggaua

SEQ ID NO: 2278 - RNA, 19 nt, Artificial Sequence
  Description of Artificial Sequence: Synthetic oligonucleotide
uauccauuauucaggaagu

SEQ ID NO: 2279 - RNA, 19 nt, Artificial Sequence
  Description of Artificial Sequence: Synthetic oligonucleotide
cuuccugaauaauggauau

SEQ ID NO: 2280 - RNA, 19 nt, Artificial Sequence
  Description of Artificial Sequence: Synthetic oligonucleotide
auauccauuauucaggaag

SEQ ID NO: 2281 - RNA, 19 nt, Artificial Sequence
  Description of Artificial Sequence: Synthetic oligonucleotide
gaauaauggauauaugugg

SEQ ID NO: 2282 - RNA, 19 nt, Artificial Sequence
  Description of Artificial Sequence: Synthetic oligonucleotide
ccacauauauccauuauuc

SEQ ID NO: 2283 - RNA, 19 nt, Artificial Sequence
  Description of Artificial Sequence: Synthetic oligonucleotide
auaauggauauauguggag

SEQ ID NO: 2284 - RNA, 19 nt, Artificial Sequence
  Description of Artificial Sequence: Synthetic oligonucleotide
cuccacauauauccauuau

SEQ ID NO: 2285 - RNA, 19 nt, Artificial Sequence
  Description of Artificial Sequence: Synthetic oligonucleotide
agauauauagauacagcug

SEQ ID NO: 2286 - RNA, 19 nt, Artificial Sequence
  Description of Artificial Sequence: Synthetic oligonucleotide
cagcuguaucuauauaucu

SEQ ID NO: 2287 - RNA, 19 nt, Artificial Sequence
  Description of Artificial Sequence: Synthetic oligonucleotide
gauauauagauacagcugu

SEQ ID NO: 2288 - RNA, 19 nt, Artificial Sequence
  Description of Artificial Sequence: Synthetic oligonucleotide
acagcuguaucuauauauc

SEQ ID NO: 2289 - RNA, 19 nt, Artificial Sequence
  Description of Artificial Sequence: Synthetic oligonucleotide
acagcuguaauuauuuagc

SEQ ID NO: 2290 - RNA, 19 nt, Artificial Sequence
  Description of Artificial Sequence: Synthetic oligonucleotide
gcuaaauaauuacagcugu

SEQ ID NO: 2291 - RNA, 19 nt, Artificial Sequence
  Description of Artificial Sequence: Synthetic oligonucleotide
cagcuguaauuauuuagcc

SEQ ID NO: 2292 - RNA, 19 nt, Artificial Sequence
  Description of Artificial Sequence: Synthetic oligonucleotide
ggcuaaauaauuacagcug

SEQ ID NO: 2293 - RNA, 19 nt, Artificial Sequence
  Description of Artificial Sequence: Synthetic oligonucleotide
agcuguaauuauuuagccu

SEQ ID NO: 2294 - RNA, 19 nt, Artificial Sequence
  Description of Artificial Sequence: Synthetic oligonucleotide
aggcuaaauaauuacagcu

SEQ ID NO: 2295 - RNA, 19 nt, Artificial Sequence
  Description of Artificial Sequence: Synthetic oligonucleotide
guaauuauuuagccucaag

SEQ ID NO: 2296 - RNA, 19 nt, Artificial Sequence
  Description of Artificial Sequence: Synthetic oligonucleotide
cuugaggcuaaauaauuac

SEQ ID NO: 2297 - RNA, 19 nt, Artificial Sequence
  Description of Artificial Sequence: Synthetic oligonucleotide
aauuauuuagccucaagug

SEQ ID NO: 2298 - RNA, 19 nt, Artificial Sequence
  Description of Artificial Sequence: Synthetic oligonucleotide
cacuugaggcuaaauaauu

SEQ ID NO: 2299 - RNA, 19 nt, Artificial Sequence
  Description of Artificial Sequence: Synthetic oligonucleotide
auuauuuagccucaaguga

SEQ ID NO: 2300 - RNA, 19 nt, Artificial Sequence
  Description of Artificial Sequence: Synthetic oligonucleotide
ucacuugaggcuaaauaau

SEQ ID NO: 2301 - RNA, 19 nt, Artificial Sequence
  Description of Artificial Sequence: Synthetic oligonucleotide
uuuagccucaagugacuuu

SEQ ID NO: 2302 - RNA, 19 nt, Artificial Sequence
  Description of Artificial Sequence: Synthetic oligonucleotide
aaagucacuugaggcuaaa

SEQ ID NO: 2303 - RNA, 19 nt, Artificial Sequence
  Description of Artificial Sequence: Synthetic oligonucleotide
aagugacuuucuccauugc

SEQ ID NO: 2304 - RNA, 19 nt, Artificial Sequence
  Description of Artificial Sequence: Synthetic oligonucleotide
gcaauggagaaagucacuu

SEQ ID NO: 2305 - RNA, 19 nt, Artificial Sequence
  Description of Artificial Sequence: Synthetic oligonucleotide
agugacuuucuccauugcu

SEQ ID NO: 2306 - RNA, 19 nt, Artificial Sequence
  Description of Artificial Sequence: Synthetic oligonucleotide
agcaauggagaaagucacu

SEQ ID NO: 2307 - RNA, 19 nt, Artificial Sequence
  Description of Artificial Sequence: Synthetic oligonucleotide
gugacuuucuccauugcuu

SEQ ID NO: 2308 - RNA, 19 nt, Artificial Sequence
  Description of Artificial Sequence: Synthetic oligonucleotide
aagcaauggagaaagucac

SEQ ID NO: 2309 - RNA, 19 nt, Artificial Sequence
  Description of Artificial Sequence: Synthetic oligonucleotide
uuucuccauugcuucacgc

SEQ ID NO: 2310 - RNA, 19 nt, Artificial Sequence
  Description of Artificial Sequence: Synthetic oligonucleotide
gcgugaagcaauggagaaa

SEQ ID NO: 2311 - RNA, 19 nt, Artificial Sequence
  Description of Artificial Sequence: Synthetic oligonucleotide
uucuccauugcuucacgcu

SEQ ID NO: 2312 - RNA, 19 nt, Artificial Sequence
  Description of Artificial Sequence: Synthetic oligonucleotide
agcgugaagcaauggagaa

SEQ ID NO: 2313 - RNA, 19 nt, Artificial Sequence
  Description of Artificial Sequence: Synthetic oligonucleotide
ucuccauugcuucacgcua

SEQ ID NO: 2314 - RNA, 19 nt, Artificial Sequence
  Description of Artificial Sequence: Synthetic oligonucleotide
uagcgugaagcaauggaga

SEQ ID NO: 2315 - RNA, 19 nt, Artificial Sequence
  Description of Artificial Sequence: Synthetic oligonucleotide
cuccauugcuucacgcuau

SEQ ID NO: 2316 - RNA, 19 nt, Artificial Sequence
  Description of Artificial Sequence: Synthetic oligonucleotide
auagcgugaagcaauggag

SEQ ID NO: 2317 - RNA, 19 nt, Artificial Sequence
  Description of Artificial Sequence: Synthetic oligonucleotide
uccauugcuucacgcuaug

SEQ ID NO: 2318 - RNA, 19 nt, Artificial Sequence
  Description of Artificial Sequence: Synthetic oligonucleotide
cauagcgugaagcaaugga

SEQ ID NO: 2319 - RNA, 19 nt, Artificial Sequence
  Description of Artificial Sequence: Synthetic oligonucleotide
ccauugcuucacgcuaugc

SEQ ID NO: 2320 - RNA, 19 nt, Artificial Sequence
  Description of Artificial Sequence: Synthetic oligonucleotide
gcauagcgugaagcaaugg

SEQ ID NO: 2321 - RNA, 19 nt, Artificial Sequence
  Description of Artificial Sequence: Synthetic oligonucleotide
cauugcuucacgcuaugcc

SEQ ID NO: 2322 - RNA, 19 nt, Artificial Sequence
  Description of Artificial Sequence: Synthetic oligonucleotide
ggcauagcgugaagcaaug

SEQ ID NO: 2323 - RNA, 19 nt, Artificial Sequence
  Description of Artificial Sequence: Synthetic oligonucleotide
auugcuucacgcuaugcca

SEQ ID NO: 2324 - RNA, 19 nt, Artificial Sequence
  Description of Artificial Sequence: Synthetic oligonucleotide
uggcauagcgugaagcaau

SEQ ID NO: 2325 - RNA, 19 nt, Artificial Sequence
  Description of Artificial Sequence: Synthetic oligonucleotide
uugcuucacgcuaugccac

SEQ ID NO: 2326 - RNA, 19 nt, Artificial Sequence
  Description of Artificial Sequence: Synthetic oligonucleotide
guggcauagcgugaagcaa

SEQ ID NO: 2327 - RNA, 19 nt, Artificial Sequence
  Description of Artificial Sequence: Synthetic oligonucleotide
ugcuucacgcuaugccacu

SEQ ID NO: 2328 - RNA, 19 nt, Artificial Sequence
  Description of Artificial Sequence: Synthetic oligonucleotide
aguggcauagcgugaagca

SEQ ID NO: 2329 - RNA, 19 nt, Artificial Sequence
  Description of Artificial Sequence: Synthetic oligonucleotide
gcuucacgcuaugccacua

SEQ ID NO: 2330 - RNA, 19 nt, Artificial Sequence
  Description of Artificial Sequence: Synthetic oligonucleotide
uaguggcauagcgugaagc

SEQ ID NO: 2331 - RNA, 19 nt, Artificial Sequence
  Description of Artificial Sequence: Synthetic oligonucleotide
cuucacgcuaugccacuau

SEQ ID NO: 2332 - RNA, 19 nt, Artificial Sequence
  Description of Artificial Sequence: Synthetic oligonucleotide
auaguggcauagcgugaag

SEQ ID NO: 2333 - RNA, 19 nt, Artificial Sequence
  Description of Artificial Sequence: Synthetic oligonucleotide
uucacgcuaugccacuauu

SEQ ID NO: 2334 - RNA, 19 nt, Artificial Sequence
  Description of Artificial Sequence: Synthetic oligonucleotide
aauaguggcauagcgugaa

SEQ ID NO: 2335 - RNA, 19 nt, Artificial Sequence
  Description of Artificial Sequence: Synthetic oligonucleotide
ucacgcuaugccacuauuu

SEQ ID NO: 2336 - RNA, 19 nt, Artificial Sequence
  Description of Artificial Sequence: Synthetic oligonucleotide
aaauaguggcauagcguga

SEQ ID NO: 2337 - RNA, 19 nt, Artificial Sequence
  Description of Artificial Sequence: Synthetic oligonucleotide
cacgcuaugccacuauuuu

SEQ ID NO: 2338 - RNA, 19 nt, Artificial Sequence
  Description of Artificial Sequence: Synthetic oligonucleotide
aaaauaguggcauagcgug

SEQ ID NO: 2339 - RNA, 19 nt, Artificial Sequence
  Description of Artificial Sequence: Synthetic oligonucleotide
cgcuaugccacuauuuugc

SEQ ID NO: 2340 - RNA, 19 nt, Artificial Sequence
  Description of Artificial Sequence: Synthetic oligonucleotide
gcaaaauaguggcauagcg

SEQ ID NO: 2341 - RNA, 19 nt, Artificial Sequence
  Description of Artificial Sequence: Synthetic oligonucleotide
gcuaugccacuauuuugcu

SEQ ID NO: 2342 - RNA, 19 nt, Artificial Sequence
  Description of Artificial Sequence: Synthetic oligonucleotide
agcaaaauaguggcauagc

SEQ ID NO: 2343 - RNA, 19 nt, Artificial Sequence
  Description of Artificial Sequence: Synthetic oligonucleotide
cuaugccacuauuuugcuu

SEQ ID NO: 2344 - RNA, 19 nt, Artificial Sequence
  Description of Artificial Sequence: Synthetic oligonucleotide
aagcaaaauaguggcauag

SEQ ID NO: 2345 - RNA, 19 nt, Artificial Sequence
  Description of Artificial Sequence: Synthetic oligonucleotide
uaugccacuauuuugcuuc

SEQ ID NO: 2346 - RNA, 19 nt, Artificial Sequence
  Description of Artificial Sequence: Synthetic oligonucleotide
gaagcaaaauaguggcaua

SEQ ID NO: 2347 - RNA, 19 nt, Artificial Sequence
  Description of Artificial Sequence: Synthetic oligonucleotide
augccacuauuuugcuucu

SEQ ID NO: 2348 - RNA, 19 nt, Artificial Sequence
  Description of Artificial Sequence: Synthetic oligonucleotide
agaagcaaaauaguggcau

SEQ ID NO: 2349 - RNA, 19 nt, Artificial Sequence
  Description of Artificial Sequence: Synthetic oligonucleotide
ugccacuauuuugcuucuu

SEQ ID NO: 2350 - RNA, 19 nt, Artificial Sequence
  Description of Artificial Sequence: Synthetic oligonucleotide
aagaagcaaaauaguggca

SEQ ID NO: 2351 - RNA, 19 nt, Artificial Sequence
  Description of Artificial Sequence: Synthetic oligonucleotide
aaccuugcuuaguauucua

SEQ ID NO: 2352 - RNA, 19 nt, Artificial Sequence
  Description of Artificial Sequence: Synthetic oligonucleotide
uagaauacuaagcaagguu

SEQ ID NO: 2353 - RNA, 19 nt, Artificial Sequence
  Description of Artificial Sequence: Synthetic oligonucleotide
ccuugcuuaguauucuaua

SEQ ID NO: 2354 - RNA, 19 nt, Artificial Sequence
  Description of Artificial Sequence: Synthetic oligonucleotide
uauagaauacuaagcaagg

SEQ ID NO: 2355 - RNA, 19 nt, Artificial Sequence
  Description of Artificial Sequence: Synthetic oligonucleotide
aguauucuauaguuugccc

SEQ ID NO: 2356 - RNA, 19 nt, Artificial Sequence
  Description of Artificial Sequence: Synthetic oligonucleotide
gggcaaacuauagaauacu

SEQ ID NO: 2357 - RNA, 19 nt, Artificial Sequence
  Description of Artificial Sequence: Synthetic oligonucleotide
guauucuauaguuugccca

SEQ ID NO: 2358 - RNA, 19 nt, Artificial Sequence
  Description of Artificial Sequence: Synthetic oligonucleotide
ugggcaaacuauagaauac

SEQ ID NO: 2359 - RNA, 19 nt, Artificial Sequence
  Description of Artificial Sequence: Synthetic oligonucleotide
uauucuauaguuugcccaa

SEQ ID NO: 2360 - RNA, 19 nt, Artificial Sequence
  Description of Artificial Sequence: Synthetic oligonucleotide
uugggcaaacuauagaaua

SEQ ID NO: 2361 - RNA, 19 nt, Artificial Sequence
  Description of Artificial Sequence: Synthetic oligonucleotide
auucuauaguuugcccaac

SEQ ID NO: 2362 - RNA, 19 nt, Artificial Sequence
  Description of Artificial Sequence: Synthetic oligonucleotide
guugggcaaacuauagaau

SEQ ID NO: 2363 - RNA, 19 nt, Artificial Sequence
  Description of Artificial Sequence: Synthetic oligonucleotide
uauaguuugcccaaccagu

SEQ ID NO: 2364 - RNA, 19 nt, Artificial Sequence
  Description of Artificial Sequence: Synthetic oligonucleotide
acugguugggcaaacuaua

SEQ ID NO: 2365 - RNA, 19 nt, Artificial Sequence
  Description of Artificial Sequence: Synthetic oligonucleotide
auaguuugcccaaccaguu

SEQ ID NO: 2366 - RNA, 19 nt, Artificial Sequence
  Description of Artificial Sequence: Synthetic oligonucleotide
aacugguugggcaaacuau

SEQ ID NO: 2367 - RNA, 19 nt, Artificial Sequence
  Description of Artificial Sequence: Synthetic oligonucleotide
uaguuugcccaaccaguuu

SEQ ID NO: 2368 - RNA, 19 nt, Artificial Sequence
  Description of Artificial Sequence: Synthetic oligonucleotide
aaacugguugggcaaacua

SEQ ID NO: 2369 - RNA, 19 nt, Artificial Sequence
  Description of Artificial Sequence: Synthetic oligonucleotide
aguuugcccaaccaguuuu

SEQ ID NO: 2370 - RNA, 19 nt, Artificial Sequence
  Description of Artificial Sequence: Synthetic oligonucleotide
aaaacugguugggcaaacu

SEQ ID NO: 2371 - RNA, 19 nt, Artificial Sequence
  Description of Artificial Sequence: Synthetic oligonucleotide
guuugcccaaccaguuuua

SEQ ID NO: 2372 - RNA, 19 nt, Artificial Sequence
  Description of Artificial Sequence: Synthetic oligonucleotide
uaaaacugguugggcaaac

SEQ ID NO: 2373 - RNA, 19 nt, Artificial Sequence
  Description of Artificial Sequence: Synthetic oligonucleotide
uuugcccaaccaguuuuac

SEQ ID NO: 2374 - RNA, 19 nt, Artificial Sequence
  Description of Artificial Sequence: Synthetic oligonucleotide
guaaaacugguugggcaaa

SEQ ID NO: 2375 - RNA, 19 nt, Artificial Sequence
  Description of Artificial Sequence: Synthetic oligonucleotide
uugcccaaccaguuuuacg

SEQ ID NO: 2376 - RNA, 19 nt, Artificial Sequence
  Description of Artificial Sequence: Synthetic oligonucleotide
cguaaaacugguugggcaa

SEQ ID NO: 2377 - RNA, 19 nt, Artificial Sequence
  Description of Artificial Sequence: Synthetic oligonucleotide
ugcccaaccaguuuuacgu

SEQ ID NO: 2378 - RNA, 19 nt, Artificial Sequence
  Description of Artificial Sequence: Synthetic oligonucleotide
acguaaaacugguugggca

SEQ ID NO: 2379 - RNA, 19 nt, Artificial Sequence
  Description of Artificial Sequence: Synthetic oligonucleotide
gcccaaccaguuuuacguc

SEQ ID NO: 2380 - RNA, 19 nt, Artificial Sequence
  Description of Artificial Sequence: Synthetic oligonucleotide
gacguaaaacugguugggc

SEQ ID NO: 2381 - RNA, 19 nt, Artificial Sequence
  Description of Artificial Sequence: Synthetic oligonucleotide
cccaaccaguuuuacgucc

SEQ ID NO: 2382 - RNA, 19 nt, Artificial Sequence
  Description of Artificial Sequence: Synthetic oligonucleotide
ggacguaaaacugguuggg

SEQ ID NO: 2383 - RNA, 19 nt, Artificial Sequence
  Description of Artificial Sequence: Synthetic oligonucleotide
ccaaccaguuuuacgucca

SEQ ID NO: 2384 - RNA, 19 nt, Artificial Sequence
  Description of Artificial Sequence: Synthetic oligonucleotide
uggacguaaaacugguugg

SEQ ID NO: 2385 - RNA, 19 nt, Artificial Sequence
  Description of Artificial Sequence: Synthetic oligonucleotide
caaccaguuuuacguccaa

SEQ ID NO: 2386 - RNA, 19 nt, Artificial Sequence
  Description of Artificial Sequence: Synthetic oligonucleotide
uuggacguaaaacugguug

SEQ ID NO: 2387 - RNA, 19 nt, Artificial Sequence
  Description of Artificial Sequence: Synthetic oligonucleotide
aaccaguuuuacguccaag

SEQ ID NO: 2388 - RNA, 19 nt, Artificial Sequence
  Description of Artificial Sequence: Synthetic oligonucleotide
cuuggacguaaaacugguu

SEQ ID NO: 2389 - RNA, 19 nt, Artificial Sequence
  Description of Artificial Sequence: Synthetic oligonucleotide
gccaaugcauaaaauauac

SEQ ID NO: 2390 - RNA, 19 nt, Artificial Sequence
  Description of Artificial Sequence: Synthetic oligonucleotide
guauauuuuaugcauuggc

SEQ ID NO: 2391 - RNA, 19 nt, Artificial Sequence
  Description of Artificial Sequence: Synthetic oligonucleotide
aacuaggugucaggguuua

SEQ ID NO: 2392 - RNA, 19 nt, Artificial Sequence
  Description of Artificial Sequence: Synthetic oligonucleotide
uaaacccugacaccuaguu

SEQ ID NO: 2393 - RNA, 19 nt, Artificial Sequence
  Description of Artificial Sequence: Synthetic oligonucleotide
acuaggugucaggguuuau

SEQ ID NO: 2394 - RNA, 19 nt, Artificial Sequence
  Description of Artificial Sequence: Synthetic oligonucleotide
auaaacccugacaccuagu

SEQ ID NO: 2395 - RNA, 19 nt, Artificial Sequence
  Description of Artificial Sequence: Synthetic oligonucleotide
cuaggugucaggguuuauc

SEQ ID NO: 2396 - RNA, 19 nt, Artificial Sequence
  Description of Artificial Sequence: Synthetic oligonucleotide
gauaaacccugacaccuag

SEQ ID NO: 2397 - RNA, 19 nt, Artificial Sequence
  Description of Artificial Sequence: Synthetic oligonucleotide
uaggugucaggguuuauca

SEQ ID NO: 2398 - RNA, 19 nt, Artificial Sequence
  Description of Artificial Sequence: Synthetic oligonucleotide
ugauaaacccugacaccua

SEQ ID NO: 2399 - RNA, 19 nt, Artificial Sequence
  Description of Artificial Sequence: Synthetic oligonucleotide
aggugucaggguuuaucaa

SEQ ID NO: 2400 - RNA, 19 nt, Artificial Sequence
  Description of Artificial Sequence: Synthetic oligonucleotide
uugauaaacccugacaccu

SEQ ID NO: 2401 - RNA, 19 nt, Artificial Sequence
  Description of Artificial Sequence: Synthetic oligonucleotide
ggugucaggguuuaucaag

SEQ ID NO: 2402 - RNA, 19 nt, Artificial Sequence
  Description of Artificial Sequence: Synthetic oligonucleotide
cuugauaaacccugacacc

SEQ ID NO: 2403 - RNA, 19 nt, Artificial Sequence
  Description of Artificial Sequence: Synthetic oligonucleotide
gugucaggguuuaucaaga

SEQ ID NO: 2404 - RNA, 19 nt, Artificial Sequence
  Description of Artificial Sequence: Synthetic oligonucleotide
ucuugauaaacccugacac

SEQ ID NO: 2405 - RNA, 19 nt, Artificial Sequence
  Description of Artificial Sequence: Synthetic oligonucleotide
ugucaggguuuaucaagaa

SEQ ID NO: 2406 - RNA, 19 nt, Artificial Sequence
  Description of Artificial Sequence: Synthetic oligonucleotide
uucuugauaaacccugaca

SEQ ID NO: 2407 - RNA, 19 nt, Artificial Sequence
  Description of Artificial Sequence: Synthetic oligonucleotide
gucaggguuuaucaagaag

SEQ ID NO: 2408 - RNA, 19 nt, Artificial Sequence
  Description of Artificial Sequence: Synthetic oligonucleotide
cuucuugauaaacccugac

SEQ ID NO: 2409 - RNA, 19 nt, Artificial Sequence
  Description of Artificial Sequence: Synthetic oligonucleotide
gguuuaucaagaaggccag

SEQ ID NO: 2410 - RNA, 19 nt, Artificial Sequence
  Description of Artificial Sequence: Synthetic oligonucleotide
cuggccuucuugauaaacc

SEQ ID NO: 2411 - RNA, 19 nt, Artificial Sequence
  Description of Artificial Sequence: Synthetic oligonucleotide
uaucaagaaggccaggaag

SEQ ID NO: 2412 - RNA, 19 nt, Artificial Sequence
  Description of Artificial Sequence: Synthetic oligonucleotide
cuuccuggccuucuugaua

SEQ ID NO: 2413 - RNA, 19 nt, Artificial Sequence
  Description of Artificial Sequence: Synthetic oligonucleotide
ucaagaaggccaggaaggc

SEQ ID NO: 2414 - RNA, 19 nt, Artificial Sequence
  Description of Artificial Sequence: Synthetic oligonucleotide
gccuuccuggccuucuuga

SEQ ID NO: 2415 - RNA, 19 nt, Artificial Sequence
  Description of Artificial Sequence: Synthetic oligonucleotide
gccaggaaggccuuuuggg

SEQ ID NO: 2416 - RNA, 19 nt, Artificial Sequence
  Description of Artificial Sequence: Synthetic oligonucleotide
cccaaaaggccuuccuggc

SEQ ID NO: 2417 - RNA, 19 nt, Artificial Sequence
  Description of Artificial Sequence: Synthetic oligonucleotide
ccaggaaggccuuuugggu

SEQ ID NO: 2418 - RNA, 19 nt, Artificial Sequence
  Description of Artificial Sequence: Synthetic oligonucleotide
acccaaaaggccuuccugg

SEQ ID NO: 2419 - RNA, 19 nt, Artificial Sequence
  Description of Artificial Sequence: Synthetic oligonucleotide
caggaaggccuuuuggguu

SEQ ID NO: 2420 - RNA, 19 nt, Artificial Sequence
  Description of Artificial Sequence: Synthetic oligonucleotide
aacccaaaaggccuuccug

SEQ ID NO: 2421 - RNA, 19 nt, Artificial Sequence
  Description of Artificial Sequence: Synthetic oligonucleotide
aggaaggccuuuuggguua

SEQ ID NO: 2422 - RNA, 19 nt, Artificial Sequence
  Description of Artificial Sequence: Synthetic oligonucleotide
uaacccaaaaggccuuccu

SEQ ID NO: 2423 - RNA, 19 nt, Artificial Sequence
  Description of Artificial Sequence: Synthetic oligonucleotide
ggaaggccuuuuggguuaa

SEQ ID NO: 2424 - RNA, 19 nt, Artificial Sequence
  Description of Artificial Sequence: Synthetic oligonucleotide
uuaacccaaaaggccuucc

SEQ ID NO: 2425 - RNA, 19 nt, Artificial Sequence
  Description of Artificial Sequence: Synthetic oligonucleotide
gaaggccuuuuggguuaag

SEQ ID NO: 2426 - RNA, 19 nt, Artificial Sequence
  Description of Artificial Sequence: Synthetic oligonucleotide
cuuaacccaaaaggccuuc

SEQ ID NO: 2427 - RNA, 19 nt, Artificial Sequence
  Description of Artificial Sequence: Synthetic oligonucleotide
aaggccuuuuggguuaagc

SEQ ID NO: 2428 - RNA, 19 nt, Artificial Sequence
  Description of Artificial Sequence: Synthetic oligonucleotide
gcuuaacccaaaaggccuu

SEQ ID NO: 2429 - RNA, 19 nt, Artificial Sequence
  Description of Artificial Sequence: Synthetic oligonucleotide
aggccuuuuggguuaagcc

SEQ ID NO: 2430 - RNA, 19 nt, Artificial Sequence
  Description of Artificial Sequence: Synthetic oligonucleotide
ggcuuaacccaaaaggccu

SEQ ID NO: 2431 - RNA, 19 nt, Artificial Sequence
  Description of Artificial Sequence: Synthetic oligonucleotide
ggccuuuuggguuaagccu

SEQ ID NO: 2432 - RNA, 19 nt, Artificial Sequence
  Description of Artificial Sequence: Synthetic oligonucleotide
aggcuuaacccaaaaggcc

SEQ ID NO: 2433 - RNA, 19 nt, Artificial Sequence
  Description of Artificial Sequence: Synthetic oligonucleotide
uuccaaaugaauggucucu

SEQ ID NO: 2434 - RNA, 19 nt, Artificial Sequence
  Description of Artificial Sequence: Synthetic oligonucleotide
agagaccauucauuuggaa

SEQ ID NO: 2435 - RNA, 19 nt, Artificial Sequence
  Description of Artificial Sequence: Synthetic oligonucleotide
uccaaaugaauggucucug

SEQ ID NO: 2436 - RNA, 19 nt, Artificial Sequence
  Description of Artificial Sequence: Synthetic oligonucleotide
cagagaccauucauuugga

SEQ ID NO: 2437 - RNA, 19 nt, Artificial Sequence
  Description of Artificial Sequence: Synthetic oligonucleotide
ccaaaugaauggucucugg

SEQ ID NO: 2438 - RNA, 19 nt, Artificial Sequence
  Description of Artificial Sequence: Synthetic oligonucleotide
ccagagaccauucauuugg

SEQ ID NO: 2439 - RNA, 19 nt, Artificial Sequence
  Description of Artificial Sequence: Synthetic oligonucleotide
caaaugaauggucucuggu

SEQ ID NO: 2440 - RNA, 19 nt, Artificial Sequence
  Description of Artificial Sequence: Synthetic oligonucleotide
accagagaccauucauuug

SEQ ID NO: 2441 - RNA, 19 nt, Artificial Sequence
  Description of Artificial Sequence: Synthetic oligonucleotide
aaaugaauggucucugguc

SEQ ID NO: 2442 - RNA, 19 nt, Artificial Sequence
  Description of Artificial Sequence: Synthetic oligonucleotide
gaccagagaccauucauuu

SEQ ID NO: 2443 - RNA, 19 nt, Artificial Sequence
  Description of Artificial Sequence: Synthetic oligonucleotide
aaugaauggucucugguca

SEQ ID NO: 2444 - RNA, 19 nt, Artificial Sequence
  Description of Artificial Sequence: Synthetic oligonucleotide
ugaccagagaccauucauu

SEQ ID NO: 2445 - RNA, 19 nt, Artificial Sequence
  Description of Artificial Sequence: Synthetic oligonucleotide
augaauggucucuggucaa

SEQ ID NO: 2446 - RNA, 19 nt, Artificial Sequence
  Description of Artificial Sequence: Synthetic oligonucleotide
uugaccagagaccauucau

SEQ ID NO: 2447 - RNA, 19 nt, Artificial Sequence
  Description of Artificial Sequence: Synthetic oligonucleotide
ugaauggucucuggucaaa

SEQ ID NO: 2448 - RNA, 19 nt, Artificial Sequence
  Description of Artificial Sequence: Synthetic oligonucleotide
uuugaccagagaccauuca

SEQ ID NO: 2449 - RNA, 19 nt, Artificial Sequence
  Description of Artificial Sequence: Synthetic oligonucleotide
gaauggucucuggucaaau

SEQ ID NO: 2450 - RNA, 19 nt, Artificial Sequence
  Description of Artificial Sequence: Synthetic oligonucleotide
auuugaccagagaccauuc

SEQ ID NO: 2451 - RNA, 19 nt, Artificial Sequence
  Description of Artificial Sequence: Synthetic oligonucleotide
aauggucucuggucaaaug

SEQ ID NO: 2452 - RNA, 19 nt, Artificial Sequence
  Description of Artificial Sequence: Synthetic oligonucleotide
cauuugaccagagaccauu

SEQ ID NO: 2453 - RNA, 19 nt, Artificial Sequence
  Description of Artificial Sequence: Synthetic oligonucleotide
gucaaaugaaugaaugguc

SEQ ID NO: 2454 - RNA, 19 nt, Artificial Sequence
  Description of Artificial Sequence: Synthetic oligonucleotide
gaccauucauucauuugac

SEQ ID NO: 2455 - RNA, 19 nt, Artificial Sequence
  Description of Artificial Sequence: Synthetic oligonucleotide
ucaaaugaaugaaugguca

SEQ ID NO: 2456 - RNA, 19 nt, Artificial Sequence
  Description of Artificial Sequence: Synthetic oligonucleotide
ugaccauucauucauuuga

SEQ ID NO: 2457 - RNA, 19 nt, Artificial Sequence
  Description of Artificial Sequence: Synthetic oligonucleotide
caaaugaaugaauggucaa

SEQ ID NO: 2458 - RNA, 19 nt, Artificial Sequence
  Description of Artificial Sequence: Synthetic oligonucleotide
uugaccauucauucauuug

SEQ ID NO: 2459 - RNA, 19 nt, Artificial Sequence
  Description of Artificial Sequence: Synthetic oligonucleotide
augaaugaauggucaaaug

SEQ ID NO: 2460 - RNA, 19 nt, Artificial Sequence
  Description of Artificial Sequence: Synthetic oligonucleotide
cauuugaccauucauucau

SEQ ID NO: 2461 - RNA, 19 nt, Artificial Sequence
  Description of Artificial Sequence: Synthetic oligonucleotide
ggucaaaugaauaaaucug

SEQ ID NO: 2462 - RNA, 19 nt, Artificial Sequence
  Description of Artificial Sequence: Synthetic oligonucleotide
cagauuuauucauuugacc

SEQ ID NO: 2463 - RNA, 19 nt, Artificial Sequence
  Description of Artificial Sequence: Synthetic oligonucleotide
gucaaaugaauaaaucugc

SEQ ID NO: 2464 - RNA, 19 nt, Artificial Sequence
  Description of Artificial Sequence: Synthetic oligonucleotide
gcagauuuauucauuugac

SEQ ID NO: 2465 - RNA, 19 nt, Artificial Sequence
  Description of Artificial Sequence: Synthetic oligonucleotide
ucaaaugaauaaaucugcc

SEQ ID NO: 2466 - RNA, 19 nt, Artificial Sequence
  Description of Artificial Sequence: Synthetic oligonucleotide
ggcagauuuauucauuuga

SEQ ID NO: 2467 - RNA, 19 nt, Artificial Sequence
  Description of Artificial Sequence: Synthetic oligonucleotide
caaaugaauaaaucugccc

SEQ ID NO: 2468 - RNA, 19 nt, Artificial Sequence
  Description of Artificial Sequence: Synthetic oligonucleotide
gggcagauuuauucauuug

SEQ ID NO: 2469 - RNA, 19 nt, Artificial Sequence
  Description of Artificial Sequence: Synthetic oligonucleotide
aaaugaauaaaucugcccu

SEQ ID NO: 2470 - RNA, 19 nt, Artificial Sequence
  Description of Artificial Sequence: Synthetic oligonucleotide
agggcagauuuauucauuu

SEQ ID NO: 2471 - RNA, 19 nt, Artificial Sequence
  Description of Artificial Sequence: Synthetic oligonucleotide
aaugaauaaaucugcccuc

SEQ ID NO: 2472 - RNA, 19 nt, Artificial Sequence
  Description of Artificial Sequence: Synthetic oligonucleotide
gagggcagauuuauucauu

SEQ ID NO: 2473 - RNA, 19 nt, Artificial Sequence
  Description of Artificial Sequence: Synthetic oligonucleotide
augaauaaaucugcccuca

SEQ ID NO: 2474 - RNA, 19 nt, Artificial Sequence
  Description of Artificial Sequence: Synthetic oligonucleotide
ugagggcagauuuauucau

SEQ ID NO: 2475 - RNA, 19 nt, Artificial Sequence
  Description of Artificial Sequence: Synthetic oligonucleotide
gaauaaaucugcccucaca

SEQ ID NO: 2476 - RNA, 19 nt, Artificial Sequence
  Description of Artificial Sequence: Synthetic oligonucleotide
ugugagggcagauuuauuc

SEQ ID NO: 2477 - RNA, 19 nt, Artificial Sequence
  Description of Artificial Sequence: Synthetic oligonucleotide
aauaaaucugcccucacag

SEQ ID NO: 2478 - RNA, 19 nt, Artificial Sequence
  Description of Artificial Sequence: Synthetic oligonucleotide
cugugagggcagauuuauu

SEQ ID NO: 2479 - RNA, 19 nt, Artificial Sequence
  Description of Artificial Sequence: Synthetic oligonucleotide
ucauaccauuugguuuaag

SEQ ID NO: 2480 - RNA, 19 nt, Artificial Sequence
  Description of Artificial Sequence: Synthetic oligonucleotide
cuuaaaccaaaugguauga

SEQ ID NO: 2481 - RNA, 19 nt, Artificial Sequence
  Description of Artificial Sequence: Synthetic oligonucleotide
auaccauuugguuuaagcc

SEQ ID NO: 2482 - RNA, 19 nt, Artificial Sequence
  Description of Artificial Sequence: Synthetic oligonucleotide
ggcuuaaaccaaaugguau

SEQ ID NO: 2483 - RNA, 19 nt, Artificial Sequence
  Description of Artificial Sequence: Synthetic oligonucleotide
uaccauuugguuuaagccu

SEQ ID NO: 2484 - RNA, 19 nt, Artificial Sequence
  Description of Artificial Sequence: Synthetic oligonucleotide
aggcuuaaaccaaauggua

SEQ ID NO: 2485 - RNA, 19 nt, Artificial Sequence
  Description of Artificial Sequence: Synthetic oligonucleotide
accauuugguuuaagccuu

SEQ ID NO: 2486 - RNA, 19 nt, Artificial Sequence
  Description of Artificial Sequence: Synthetic oligonucleotide
aaggcuuaaaccaaauggu

SEQ ID NO: 2487 - RNA, 19 nt, Artificial Sequence
  Description of Artificial Sequence: Synthetic oligonucleotide
ccauuugguuuaagccuua

SEQ ID NO: 2488 - RNA, 19 nt, Artificial Sequence
  Description of Artificial Sequence: Synthetic oligonucleotide
uaaggcuuaaaccaaaugg

SEQ ID NO: 2489 - RNA, 19 nt, Artificial Sequence
  Description of Artificial Sequence: Synthetic oligonucleotide
cauuugguuuaagccuuac

SEQ ID NO: 2490 - RNA, 19 nt, Artificial Sequence
  Description of Artificial Sequence: Synthetic oligonucleotide
guaaggcuuaaaccaaaug

SEQ ID NO: 2491 - RNA, 19 nt, Artificial Sequence
  Description of Artificial Sequence: Synthetic oligonucleotide
auuugguuuaagccuuaca

SEQ ID NO: 2492 - RNA, 19 nt, Artificial Sequence
  Description of Artificial Sequence: Synthetic oligonucleotide
uguaaggcuuaaaccaaau

SEQ ID NO: 2493 - RNA, 19 nt, Artificial Sequence
  Description of Artificial Sequence: Synthetic oligonucleotide
guuuaagccuuacauucau

SEQ ID NO: 2494 - RNA, 19 nt, Artificial Sequence
  Description of Artificial Sequence: Synthetic oligonucleotide
augaauguaaggcuuaaac

SEQ ID NO: 2495 - RNA, 19 nt, Artificial Sequence
  Description of Artificial Sequence: Synthetic oligonucleotide
uuuaagccuuacauucaug

SEQ ID NO: 2496 - RNA, 19 nt, Artificial Sequence
  Description of Artificial Sequence: Synthetic oligonucleotide
caugaauguaaggcuuaaa

SEQ ID NO: 2497 - RNA, 19 nt, Artificial Sequence
  Description of Artificial Sequence: Synthetic oligonucleotide
uuccaaaugaagucgaauc

SEQ ID NO: 2498 - RNA, 19 nt, Artificial Sequence
  Description of Artificial Sequence: Synthetic oligonucleotide
gauucgacuucauuuggaa

SEQ ID NO: 2499 - RNA, 19 nt, Artificial Sequence
  Description of Artificial Sequence: Synthetic oligonucleotide
uccaaaugaagucgaaucu

SEQ ID NO: 2500 - RNA, 19 nt, Artificial Sequence
  Description of Artificial Sequence: Synthetic oligonucleotide
agauucgacuucauuugga

SEQ ID NO: 2501 - RNA, 19 nt, Artificial Sequence
  Description of Artificial Sequence: Synthetic oligonucleotide
ccaaaugaagucgaaucug

SEQ ID NO: 2502 - RNA, 19 nt, Artificial Sequence
  Description of Artificial Sequence: Synthetic oligonucleotide
cagauucgacuucauuugg

SEQ ID NO: 2503 - RNA, 19 nt, Artificial Sequence
  Description of Artificial Sequence: Synthetic oligonucleotide
aaaugaagucgaaucugcc

SEQ ID NO: 2504 - RNA, 19 nt, Artificial Sequence
  Description of Artificial Sequence: Synthetic oligonucleotide
ggcagauucgacuucauuu

SEQ ID NO: 2505 - RNA, 19 nt, Artificial Sequence
  Description of Artificial Sequence: Synthetic oligonucleotide
aaugaagucgaaucugccc

SEQ ID NO: 2506 - RNA, 19 nt, Artificial Sequence
  Description of Artificial Sequence: Synthetic oligonucleotide
gggcagauucgacuucauu

SEQ ID NO: 2507 - RNA, 19 nt, Artificial Sequence
  Description of Artificial Sequence: Synthetic oligonucleotide
augaagucgaaucugcccu

SEQ ID NO: 2508 - RNA, 19 nt, Artificial Sequence
  Description of Artificial Sequence: Synthetic oligonucleotide
agggcagauucgacuucau

SEQ ID NO: 2509 - RNA, 19 nt, Artificial Sequence
  Description of Artificial Sequence: Synthetic oligonucleotide
ugaagucgaaucugcccuc

SEQ ID NO: 2510 - RNA, 19 nt, Artificial Sequence
  Description of Artificial Sequence: Synthetic oligonucleotide
gagggcagauucgacuuca

SEQ ID NO: 2511 - RNA, 19 nt, Artificial Sequence
  Description of Artificial Sequence: Synthetic oligonucleotide
gaagucgaaucugcccuca

SEQ ID NO: 2512 - RNA, 19 nt, Artificial Sequence
  Description of Artificial Sequence: Synthetic oligonucleotide
ugagggcagauucgacuuc

SEQ ID NO: 2513 - RNA, 19 nt, Artificial Sequence
  Description of Artificial Sequence: Synthetic oligonucleotide
aagucgaaucugcccucac

SEQ ID NO: 2514 - RNA, 19 nt, Artificial Sequence
  Description of Artificial Sequence: Synthetic oligonucleotide
gugagggcagauucgacuu

SEQ ID NO: 2515 - RNA, 19 nt, Artificial Sequence
  Description of Artificial Sequence: Synthetic oligonucleotide
agucgaaucugcccucaca

SEQ ID NO: 2516 - RNA, 19 nt, Artificial Sequence
  Description of Artificial Sequence: Synthetic oligonucleotide
ugugagggcagauucgacu

SEQ ID NO: 2517 - RNA, 19 nt, Artificial Sequence
  Description of Artificial Sequence: Synthetic oligonucleotide
gucgaaucugcccucacag

SEQ ID NO: 2518 - RNA, 19 nt, Artificial Sequence
  Description of Artificial Sequence: Synthetic oligonucleotide
cugugagggcagauucgac

SEQ ID NO: 2519 - RNA, 19 nt, Artificial Sequence
  Description of Artificial Sequence: Synthetic oligonucleotide
uuguauuguguauuuucgg

SEQ ID NO: 2520 - RNA, 19 nt, Artificial Sequence
  Description of Artificial Sequence: Synthetic oligonucleotide
ccgaaaauacacaauacaa

SEQ ID NO: 2521 - RNA, 19 nt, Artificial Sequence
  Description of Artificial Sequence: Synthetic oligonucleotide
uguauuguguauuuucggu

SEQ ID NO: 2522 - RNA, 19 nt, Artificial Sequence
  Description of Artificial Sequence: Synthetic oligonucleotide
accgaaaauacacaauaca

SEQ ID NO: 2523 - RNA, 19 nt, Artificial Sequence
  Description of Artificial Sequence: Synthetic oligonucleotide
guauuguguauuuucgguu

SEQ ID NO: 2524 - RNA, 19 nt, Artificial Sequence
  Description of Artificial Sequence: Synthetic oligonucleotide
aaccgaaaauacacaauac

SEQ ID NO: 2525 - RNA, 19 nt, Artificial Sequence
  Description of Artificial Sequence: Synthetic oligonucleotide
aaauauuuagaugcagcac

SEQ ID NO: 2526 - RNA, 19 nt, Artificial Sequence
  Description of Artificial Sequence: Synthetic oligonucleotide
gugcugcaucuaaauauuu

SEQ ID NO: 2527 - RNA, 19 nt, Artificial Sequence
  Description of Artificial Sequence: Synthetic oligonucleotide
auuuagaugcagcaccaua

SEQ ID NO: 2528 - RNA, 19 nt, Artificial Sequence
  Description of Artificial Sequence: Synthetic oligonucleotide
uauggugcugcaucuaaau

SEQ ID NO: 2529 - RNA, 19 nt, Artificial Sequence
  Description of Artificial Sequence: Synthetic oligonucleotide
uuuagaugcagcaccauau

SEQ ID NO: 2530 - RNA, 19 nt, Artificial Sequence
  Description of Artificial Sequence: Synthetic oligonucleotide
auauggugcugcaucuaaa

SEQ ID NO: 2531 - RNA, 19 nt, Artificial Sequence
  Description of Artificial Sequence: Synthetic oligonucleotide
uuagaugcagcaccauauu

SEQ ID NO: 2532 - RNA, 19 nt, Artificial Sequence
  Description of Artificial Sequence: Synthetic oligonucleotide
aauauggugcugcaucuaa

SEQ ID NO: 2533 - RNA, 19 nt, Artificial Sequence
  Description of Artificial Sequence: Synthetic oligonucleotide
uagaugcagcaccauauuu

SEQ ID NO: 2534 - RNA, 19 nt, Artificial Sequence
  Description of Artificial Sequence: Synthetic oligonucleotide
aaauauggugcugcaucua

SEQ ID NO: 2535 - RNA, 19 nt, Artificial Sequence
  Description of Artificial Sequence: Synthetic oligonucleotide
agaugcagcaccauauuuu

SEQ ID NO: 2536 - RNA, 19 nt, Artificial Sequence
  Description of Artificial Sequence: Synthetic oligonucleotide
aaaauauggugcugcaucu

SEQ ID NO: 2537 - RNA, 19 nt, Artificial Sequence
  Description of Artificial Sequence: Synthetic oligonucleotide
gaugcagcaccauauuuua

SEQ ID NO: 2538 - RNA, 19 nt, Artificial Sequence
  Description of Artificial Sequence: Synthetic oligonucleotide
uaaaauauggugcugcauc

SEQ ID NO: 2539 - RNA, 19 nt, Artificial Sequence
  Description of Artificial Sequence: Synthetic oligonucleotide
augcagcaccauauuuuau

SEQ ID NO: 2540 - RNA, 19 nt, Artificial Sequence
  Description of Artificial Sequence: Synthetic oligonucleotide
auaaaauauggugcugcau

SEQ ID NO: 2541 - RNA, 19 nt, Artificial Sequence
  Description of Artificial Sequence: Synthetic oligonucleotide
agcaccauauuuuauaacc

SEQ ID NO: 2542 - RNA, 19 nt, Artificial Sequence
  Description of Artificial Sequence: Synthetic oligonucleotide
gguuauaaaauauggugcu

SEQ ID NO: 2543 - RNA, 19 nt, Artificial Sequence
  Description of Artificial Sequence: Synthetic oligonucleotide
gcaccauauuuuauaaccc

SEQ ID NO: 2544 - RNA, 19 nt, Artificial Sequence
  Description of Artificial Sequence: Synthetic oligonucleotide
ggguuauaaaauauggugc

SEQ ID NO: 2545 - RNA, 19 nt, Artificial Sequence
  Description of Artificial Sequence: Synthetic oligonucleotide
accauauuuuauaacccag

SEQ ID NO: 2546 - RNA, 19 nt, Artificial Sequence
  Description of Artificial Sequence: Synthetic oligonucleotide
cuggguuauaaaauauggu

SEQ ID NO: 2547 - RNA, 19 nt, Artificial Sequence
  Description of Artificial Sequence: Synthetic oligonucleotide
ccauauuuuauaacccagc

SEQ ID NO: 2548 - RNA, 19 nt, Artificial Sequence
  Description of Artificial Sequence: Synthetic oligonucleotide
gcuggguuauaaaauaugg

SEQ ID NO: 2549 - RNA, 19 nt, Artificial Sequence
  Description of Artificial Sequence: Synthetic oligonucleotide
cauauuuuauaacccagcu

SEQ ID NO: 2550 - RNA, 19 nt, Artificial Sequence
  Description of Artificial Sequence: Synthetic oligonucleotide
agcuggguuauaaaauaug

SEQ ID NO: 2551 - RNA, 19 nt, Artificial Sequence
  Description of Artificial Sequence: Synthetic oligonucleotide
uuauaacccagcuuuagca

SEQ ID NO: 2552 - RNA, 19 nt, Artificial Sequence
  Description of Artificial Sequence: Synthetic oligonucleotide
ugcuaaagcuggguuauaa

SEQ ID NO: 2553 - RNA, 19 nt, Artificial Sequence
  Description of Artificial Sequence: Synthetic oligonucleotide
acccagcuuuagcauuucu

SEQ ID NO: 2554 - RNA, 19 nt, Artificial Sequence
  Description of Artificial Sequence: Synthetic oligonucleotide
agaaaugcuaaagcugggu

SEQ ID NO: 2555 - RNA, 19 nt, Artificial Sequence
  Description of Artificial Sequence: Synthetic oligonucleotide
ccagcuuuagcauuucuuc

SEQ ID NO: 2556 - RNA, 19 nt, Artificial Sequence
  Description of Artificial Sequence: Synthetic oligonucleotide
gaagaaaugcuaaagcugg

SEQ ID NO: 2557 - RNA, 19 nt, Artificial Sequence
  Description of Artificial Sequence: Synthetic oligonucleotide
ggcgcuucuugcucucuga

SEQ ID NO: 2558 - RNA, 19 nt, Artificial Sequence
  Description of Artificial Sequence: Synthetic oligonucleotide
ucagagagcaagaagcgcc

SEQ ID NO: 2559 - RNA, 19 nt, Artificial Sequence
  Description of Artificial Sequence: Synthetic oligonucleotide
gcgcuucuugcucucugaa

SEQ ID NO: 2560 - RNA, 19 nt, Artificial Sequence
  Description of Artificial Sequence: Synthetic oligonucleotide
uucagagagcaagaagcgc

SEQ ID NO: 2561 - RNA, 19 nt, Artificial Sequence
  Description of Artificial Sequence: Synthetic oligonucleotide
aaaugcccugcuaaaugcu

SEQ ID NO: 2562 - RNA, 19 nt, Artificial Sequence
  Description of Artificial Sequence: Synthetic oligonucleotide
agcauuuagcagggcauuu

SEQ ID NO: 2563 - RNA, 19 nt, Artificial Sequence
  Description of Artificial Sequence: Synthetic oligonucleotide
aaugcccugcuaaaugcuu

SEQ ID NO: 2564 - RNA, 19 nt, Artificial Sequence
  Description of Artificial Sequence: Synthetic oligonucleotide
aagcauuuagcagggcauu

SEQ ID NO: 2565 - RNA, 19 nt, Artificial Sequence
  Description of Artificial Sequence: Synthetic oligonucleotide
augcccugcuaaaugcuuc

SEQ ID NO: 2566 - RNA, 19 nt, Artificial Sequence
  Description of Artificial Sequence: Synthetic oligonucleotide
gaagcauuuagcagggcau

SEQ ID NO: 2567 - RNA, 19 nt, Artificial Sequence
  Description of Artificial Sequence: Synthetic oligonucleotide
ugcccugcuaaaugcuucu

SEQ ID NO: 2568 - RNA, 19 nt, Artificial Sequence
  Description of Artificial Sequence: Synthetic oligonucleotide
agaagcauuuagcagggca

SEQ ID NO: 2569 - RNA, 19 nt, Artificial Sequence
  Description of Artificial Sequence: Synthetic oligonucleotide
uuugaauaagguaguuugg

SEQ ID NO: 2570 - RNA, 19 nt, Artificial Sequence
  Description of Artificial Sequence: Synthetic oligonucleotide
ccaaacuaccuuauucaaa

SEQ ID NO: 2571 - RNA, 19 nt, Artificial Sequence
  Description of Artificial Sequence: Synthetic oligonucleotide
uugaauaagguaguuugga

SEQ ID NO: 2572 - RNA, 19 nt, Artificial Sequence
  Description of Artificial Sequence: Synthetic oligonucleotide
uccaaacuaccuuauucaa

SEQ ID NO: 2573 - RNA, 19 nt, Artificial Sequence
  Description of Artificial Sequence: Synthetic oligonucleotide
ugaauaagguaguuuggaa

SEQ ID NO: 2574 - RNA, 19 nt, Artificial Sequence
  Description of Artificial Sequence: Synthetic oligonucleotide
uuccaaacuaccuuauuca

SEQ ID NO: 2575 - RNA, 19 nt, Artificial Sequence
  Description of Artificial Sequence: Synthetic oligonucleotide
gaauaagguaguuuggaau

SEQ ID NO: 2576 - RNA, 19 nt, Artificial Sequence
  Description of Artificial Sequence: Synthetic oligonucleotide
auuccaaacuaccuuauuc

SEQ ID NO: 2577 - RNA, 19 nt, Artificial Sequence
  Description of Artificial Sequence: Synthetic oligonucleotide
agguaguuuggaauaaaga

SEQ ID NO: 2578 - RNA, 19 nt, Artificial Sequence
  Description of Artificial Sequence: Synthetic oligonucleotide
ucuuuauuccaaacuaccu

SEQ ID NO: 2579 - RNA, 19 nt, Artificial Sequence
  Description of Artificial Sequence: Synthetic oligonucleotide
gaucacucuacauacagau

SEQ ID NO: 2580 - RNA, 19 nt, Artificial Sequence
  Description of Artificial Sequence: Synthetic oligonucleotide
aucuguauguagagugauc

SEQ ID NO: 2581 - RNA, 19 nt, Artificial Sequence
  Description of Artificial Sequence: Synthetic oligonucleotide
aucacucuacauacagaua

SEQ ID NO: 2582 - RNA, 19 nt, Artificial Sequence
  Description of Artificial Sequence: Synthetic oligonucleotide
uaucuguauguagagugau

SEQ ID NO: 2583 - RNA, 19 nt, Artificial Sequence
  Description of Artificial Sequence: Synthetic oligonucleotide
ucacucuacauacagauag

SEQ ID NO: 2584 - RNA, 19 nt, Artificial Sequence
  Description of Artificial Sequence: Synthetic oligonucleotide
cuaucuguauguagaguga

SEQ ID NO: 2585 - RNA, 19 nt, Artificial Sequence
  Description of Artificial Sequence: Synthetic oligonucleotide
cacucuacauacagauagu

SEQ ID NO: 2586 - RNA, 19 nt, Artificial Sequence
  Description of Artificial Sequence: Synthetic oligonucleotide
acuaucuguauguagagug

SEQ ID NO: 2587 - RNA, 19 nt, Artificial Sequence
  Description of Artificial Sequence: Synthetic oligonucleotide
acucuacauacagauagua

SEQ ID NO: 2588 - RNA, 19 nt, Artificial Sequence
  Description of Artificial Sequence: Synthetic oligonucleotide
uacuaucuguauguagagu

SEQ ID NO: 2589 - RNA, 19 nt, Artificial Sequence
  Description of Artificial Sequence: Synthetic oligonucleotide
cucuacauacagauaguaa

SEQ ID NO: 2590 - RNA, 19 nt, Artificial Sequence
  Description of Artificial Sequence: Synthetic oligonucleotide
uuacuaucuguauguagag

SEQ ID NO: 2591 - RNA, 19 nt, Artificial Sequence
  Description of Artificial Sequence: Synthetic oligonucleotide
uguaaaugacugauguuug

SEQ ID NO: 2592 - RNA, 19 nt, Artificial Sequence
  Description of Artificial Sequence: Synthetic oligonucleotide
caaacaucagucauuuaca

SEQ ID NO: 2593 - RNA, 19 nt, Artificial Sequence
  Description of Artificial Sequence: Synthetic oligonucleotide
guaaaugacugauguuugc

SEQ ID NO: 2594 - RNA, 19 nt, Artificial Sequence
  Description of Artificial Sequence: Synthetic oligonucleotide
gcaaacaucagucauuuac

SEQ ID NO: 2595 - RNA, 19 nt, Artificial Sequence
  Description of Artificial Sequence: Synthetic oligonucleotide
uaaaugacugauguuugca

SEQ ID NO: 2596 - RNA, 19 nt, Artificial Sequence
  Description of Artificial Sequence: Synthetic oligonucleotide
ugcaaacaucagucauuua

SEQ ID NO: 2597 - RNA, 19 nt, Artificial Sequence
  Description of Artificial Sequence: Synthetic oligonucleotide
aaaugacugauguuugcau

SEQ ID NO: 2598 - RNA, 19 nt, Artificial Sequence
  Description of Artificial Sequence: Synthetic oligonucleotide
augcaaacaucagucauuu

SEQ ID NO: 2599 - RNA, 19 nt, Artificial Sequence
  Description of Artificial Sequence: Synthetic oligonucleotide
gauguuugcauuauuaagg

SEQ ID NO: 2600 - RNA, 19 nt, Artificial Sequence
  Description of Artificial Sequence: Synthetic oligonucleotide
ccuuaauaaugcaaacauc

SEQ ID NO: 2601 - RNA, 19 nt, Artificial Sequence
  Description of Artificial Sequence: Synthetic oligonucleotide
acuugggauguugggucaa

SEQ ID NO: 2602 - RNA, 19 nt, Artificial Sequence
  Description of Artificial Sequence: Synthetic oligonucleotide
uugacccaacaucccaagu

SEQ ID NO: 2603 - RNA, 19 nt, Artificial Sequence
  Description of Artificial Sequence: Synthetic oligonucleotide
uugggauguugggucaaga

SEQ ID NO: 2604 - RNA, 19 nt, Artificial Sequence
  Description of Artificial Sequence: Synthetic oligonucleotide
ucuugacccaacaucccaa

SEQ ID NO: 2605 - RNA, 19 nt, Artificial Sequence
  Description of Artificial Sequence: Synthetic oligonucleotide
ugggauguugggucaagag

SEQ ID NO: 2606 - RNA, 19 nt, Artificial Sequence
  Description of Artificial Sequence: Synthetic oligonucleotide
cucuugacccaacauccca

SEQ ID NO: 2607 - RNA, 19 nt, Artificial Sequence
  Description of Artificial Sequence: Synthetic oligonucleotide
gggauguugggucaagagg

SEQ ID NO: 2608 - RNA, 19 nt, Artificial Sequence
  Description of Artificial Sequence: Synthetic oligonucleotide
ccucuugacccaacauccc

SEQ ID NO: 2609 - RNA, 19 nt, Artificial Sequence
  Description of Artificial Sequence: Synthetic oligonucleotide
aaaguguuagucaauccac

SEQ ID NO: 2610 - RNA, 19 nt, Artificial Sequence
  Description of Artificial Sequence: Synthetic oligonucleotide
guggauugacuaacacuuu

SEQ ID NO: 2611 - RNA, 19 nt, Artificial Sequence
  Description of Artificial Sequence: Synthetic oligonucleotide
gaaggucaauuauaauucc

SEQ ID NO: 2612 - RNA, 19 nt, Artificial Sequence
  Description of Artificial Sequence: Synthetic oligonucleotide
ggaauuauaauugaccuuc

SEQ ID NO: 2613 - RNA, 19 nt, Artificial Sequence
  Description of Artificial Sequence: Synthetic oligonucleotide
ccauauaccuuucuuugau

SEQ ID NO: 2614 - RNA, 19 nt, Artificial Sequence
  Description of Artificial Sequence: Synthetic oligonucleotide
aucaaagaaagguauaugg

SEQ ID NO: 2615 - RNA, 19 nt, Artificial Sequence
  Description of Artificial Sequence: Synthetic oligonucleotide
cauauaccuuucuuugaug

SEQ ID NO: 2616 - RNA, 19 nt, Artificial Sequence
  Description of Artificial Sequence: Synthetic oligonucleotide
caucaaagaaagguauaug

SEQ ID NO: 2617 - RNA, 19 nt, Artificial Sequence
  Description of Artificial Sequence: Synthetic oligonucleotide
auauaccuuucuuugaugc

SEQ ID NO: 2618 - RNA, 19 nt, Artificial Sequence
  Description of Artificial Sequence: Synthetic oligonucleotide
gcaucaaagaaagguauau

SEQ ID NO: 2619 - RNA, 19 nt, Artificial Sequence
  Description of Artificial Sequence: Synthetic oligonucleotide
uauaccuuucuuugaugcc

SEQ ID NO: 2620 - RNA, 19 nt, Artificial Sequence
  Description of Artificial Sequence: Synthetic oligonucleotide
ggcaucaaagaaagguaua

SEQ ID NO: 2621 - RNA, 19 nt, Artificial Sequence
  Description of Artificial Sequence: Synthetic oligonucleotide
accuuucuuugaugccaca

SEQ ID NO: 2622 - RNA, 19 nt, Artificial Sequence
  Description of Artificial Sequence: Synthetic oligonucleotide
uguggcaucaaagaaaggu

SEQ ID NO: 2623 - RNA, 19 nt, Artificial Sequence
  Description of Artificial Sequence: Synthetic oligonucleotide
agaauacaguuuggguggc

SEQ ID NO: 2624 - RNA, 19 nt, Artificial Sequence
  Description of Artificial Sequence: Synthetic oligonucleotide
gccacccaaacuguauucu

SEQ ID NO: 2625 - RNA, 19 nt, Artificial Sequence
  Description of Artificial Sequence: Synthetic oligonucleotide
gaauacaguuuggguggcc

SEQ ID NO: 2626 - RNA, 19 nt, Artificial Sequence
  Description of Artificial Sequence: Synthetic oligonucleotide
ggccacccaaacuguauuc

SEQ ID NO: 2627 - RNA, 19 nt, Artificial Sequence
  Description of Artificial Sequence: Synthetic oligonucleotide
aauacaguuuggguggcca

SEQ ID NO: 2628 - RNA, 19 nt, Artificial Sequence
  Description of Artificial Sequence: Synthetic oligonucleotide
uggccacccaaacuguauu

SEQ ID NO: 2629 - RNA, 19 nt, Artificial Sequence
  Description of Artificial Sequence: Synthetic oligonucleotide
auacaguuuggguggccau

SEQ ID NO: 2630 - RNA, 19 nt, Artificial Sequence
  Description of Artificial Sequence: Synthetic oligonucleotide
auggccacccaaacuguau

SEQ ID NO: 2631 - RNA, 19 nt, Artificial Sequence
  Description of Artificial Sequence: Synthetic oligonucleotide
uacaguuuggguggccaug

SEQ ID NO: 2632 - RNA, 19 nt, Artificial Sequence
  Description of Artificial Sequence: Synthetic oligonucleotide
cauggccacccaaacugua

SEQ ID NO: 2633 - RNA, 19 nt, Artificial Sequence
  Description of Artificial Sequence: Synthetic oligonucleotide
acaguuuggguggccaugg

SEQ ID NO: 2634 - RNA, 19 nt, Artificial Sequence
  Description of Artificial Sequence: Synthetic oligonucleotide
ccauggccacccaaacugu

SEQ ID NO: 2635 - RNA, 19 nt, Artificial Sequence
  Description of Artificial Sequence: Synthetic oligonucleotide
caguuuggguggccaugga

SEQ ID NO: 2636 - RNA, 19 nt, Artificial Sequence
  Description of Artificial Sequence: Synthetic oligonucleotide
uccauggccacccaaacug

SEQ ID NO: 2637 - RNA, 19 nt, Artificial Sequence
  Description of Artificial Sequence: Synthetic oligonucleotide
aguuuggguggccauggau

SEQ ID NO: 2638 - RNA, 19 nt, Artificial Sequence
  Description of Artificial Sequence: Synthetic oligonucleotide
auccauggccacccaaacu

SEQ ID NO: 2639 - RNA, 19 nt, Artificial Sequence
  Description of Artificial Sequence: Synthetic oligonucleotide
guuuggguggccauggaug

SEQ ID NO: 2640 - RNA, 19 nt, Artificial Sequence
  Description of Artificial Sequence: Synthetic oligonucleotide
cauccauggccacccaaac

SEQ ID NO: 2641 - RNA, 19 nt, Artificial Sequence
  Description of Artificial Sequence: Synthetic oligonucleotide
uuuggguggccauggaugu

SEQ ID NO: 2642 - RNA, 19 nt, Artificial Sequence
  Description of Artificial Sequence: Synthetic oligonucleotide
acauccauggccacccaaa

SEQ ID NO: 2643 - RNA, 19 nt, Artificial Sequence
  Description of Artificial Sequence: Synthetic oligonucleotide
ucagaucauuucauggaau

SEQ ID NO: 2644 - RNA, 19 nt, Artificial Sequence
  Description of Artificial Sequence: Synthetic oligonucleotide
auuccaugaaaugaucuga

SEQ ID NO: 2645 - RNA, 19 nt, Artificial Sequence
  Description of Artificial Sequence: Synthetic oligonucleotide
cagaucauuucauggaauc

SEQ ID NO: 2646 - RNA, 19 nt, Artificial Sequence
  Description of Artificial Sequence: Synthetic oligonucleotide
gauuccaugaaaugaucug

SEQ ID NO: 2647 - RNA, 19 nt, Artificial Sequence
  Description of Artificial Sequence: Synthetic oligonucleotide
gaucauuucauggaaucuu

SEQ ID NO: 2648 - RNA, 19 nt, Artificial Sequence
  Description of Artificial Sequence: Synthetic oligonucleotide
aagauuccaugaaaugauc

SEQ ID NO: 2649 - RNA, 19 nt, Artificial Sequence
  Description of Artificial Sequence: Synthetic oligonucleotide
aaguaucuuugacucuaac

SEQ ID NO: 2650 - RNA, 19 nt, Artificial Sequence
  Description of Artificial Sequence: Synthetic oligonucleotide
guuagagucaaagauacuu

SEQ ID NO: 2651 - RNA, 19 nt, Artificial Sequence
  Description of Artificial Sequence: Synthetic oligonucleotide
aguaucuuugacucuaacu

SEQ ID NO: 2652 - RNA, 19 nt, Artificial Sequence
  Description of Artificial Sequence: Synthetic oligonucleotide
aguuagagucaaagauacu

SEQ ID NO: 2653 - RNA, 19 nt, Artificial Sequence
  Description of Artificial Sequence: Synthetic oligonucleotide
guaucuuugacucuaacuu

SEQ ID NO: 2654 - RNA, 19 nt, Artificial Sequence
  Description of Artificial Sequence: Synthetic oligonucleotide
aaguuagagucaaagauac

SEQ ID NO: 2655 - RNA, 19 nt, Artificial Sequence
  Description of Artificial Sequence: Synthetic oligonucleotide
aucuuugacucuaacuuug

SEQ ID NO: 2656 - RNA, 19 nt, Artificial Sequence
  Description of Artificial Sequence: Synthetic oligonucleotide
caaaguuagagucaaagau

SEQ ID NO: 2657 - RNA, 19 nt, Artificial Sequence
  Description of Artificial Sequence: Synthetic oligonucleotide
ucuuugacucuaacuuuga

SEQ ID NO: 2658 - RNA, 19 nt, Artificial Sequence
  Description of Artificial Sequence: Synthetic oligonucleotide
ucaaaguuagagucaaaga

SEQ ID NO: 2659 - RNA, 19 nt, Artificial Sequence
  Description of Artificial Sequence: Synthetic oligonucleotide
cuuugacucuaacuuugac

SEQ ID NO: 2660 - RNA, 19 nt, Artificial Sequence
  Description of Artificial Sequence: Synthetic oligonucleotide
gucaaaguuagagucaaag

SEQ ID NO: 2661 - RNA, 19 nt, Artificial Sequence
  Description of Artificial Sequence: Synthetic oligonucleotide
uuugacucuaacuuugacu

SEQ ID NO: 2662 - RNA, 19 nt, Artificial Sequence
  Description of Artificial Sequence: Synthetic oligonucleotide
agucaaaguuagagucaaa

SEQ ID NO: 2663 - RNA, 19 nt, Artificial Sequence
  Description of Artificial Sequence: Synthetic oligonucleotide
uugacucuaacuuugacuu

SEQ ID NO: 2664 - RNA, 19 nt, Artificial Sequence
  Description of Artificial Sequence: Synthetic oligonucleotide
aagucaaaguuagagucaa

SEQ ID NO: 2665 - RNA, 19 nt, Artificial Sequence
  Description of Artificial Sequence: Synthetic oligonucleotide
cucuaacuuugacuuggug

SEQ ID NO: 2666 - RNA, 19 nt, Artificial Sequence
  Description of Artificial Sequence: Synthetic oligonucleotide
caccaagucaaaguuagag

SEQ ID NO: 2667 - RNA, 19 nt, Artificial Sequence
  Description of Artificial Sequence: Synthetic oligonucleotide
ucuaacuuugacuuggugg

SEQ ID NO: 2668 - RNA, 19 nt, Artificial Sequence
  Description of Artificial Sequence: Synthetic oligonucleotide
ccaccaagucaaaguuaga

SEQ ID NO: 2669 - RNA, 19 nt, Artificial Sequence
  Description of Artificial Sequence: Synthetic oligonucleotide
cuaacuuugacuugguggu

SEQ ID NO: 2670 - RNA, 19 nt, Artificial Sequence
  Description of Artificial Sequence: Synthetic oligonucleotide
accaccaagucaaaguuag

SEQ ID NO: 2671 - RNA, 19 nt, Artificial Sequence
  Description of Artificial Sequence: Synthetic oligonucleotide
uaacuuugacuugguggug

SEQ ID NO: 2672 - RNA, 19 nt, Artificial Sequence
  Description of Artificial Sequence: Synthetic oligonucleotide
caccaccaagucaaaguua

SEQ ID NO: 2673 - RNA, 19 nt, Artificial Sequence
  Description of Artificial Sequence: Synthetic oligonucleotide
acuuugacuugguggugga

SEQ ID NO: 2674 - RNA, 19 nt, Artificial Sequence
  Description of Artificial Sequence: Synthetic oligonucleotide
uccaccaccaagucaaagu

SEQ ID NO: 2675 - RNA, 19 nt, Artificial Sequence
  Description of Artificial Sequence: Synthetic oligonucleotide
cuuugacuuggugguggac

SEQ ID NO: 2676 - RNA, 19 nt, Artificial Sequence
  Description of Artificial Sequence: Synthetic oligonucleotide
guccaccaccaagucaaag

SEQ ID NO: 2677 - RNA, 19 nt, Artificial Sequence
  Description of Artificial Sequence: Synthetic oligonucleotide
uuugacuuggugguggacc

SEQ ID NO: 2678 - RNA, 19 nt, Artificial Sequence
  Description of Artificial Sequence: Synthetic oligonucleotide
gguccaccaccaagucaaa

SEQ ID NO: 2679 - RNA, 19 nt, Artificial Sequence
  Description of Artificial Sequence: Synthetic oligonucleotide
uugacuuggugguggaccu

SEQ ID NO: 2680 - RNA, 19 nt, Artificial Sequence
  Description of Artificial Sequence: Synthetic oligonucleotide
agguccaccaccaagucaa

SEQ ID NO: 2681 - RNA, 19 nt, Artificial Sequence
  Description of Artificial Sequence: Synthetic oligonucleotide
ugacuuggugguggaccuu

SEQ ID NO: 2682 - RNA, 19 nt, Artificial Sequence
  Description of Artificial Sequence: Synthetic oligonucleotide
aagguccaccaccaaguca

SEQ ID NO: 2683 - RNA, 19 nt, Artificial Sequence
  Description of Artificial Sequence: Synthetic oligonucleotide
uuggugguggaccuuccuu

SEQ ID NO: 2684 - RNA, 19 nt, Artificial Sequence
  Description of Artificial Sequence: Synthetic oligonucleotide
aaggaagguccaccaccaa

SEQ ID NO: 2685 - RNA, 19 nt, Artificial Sequence
  Description of Artificial Sequence: Synthetic oligonucleotide
uggugguggaccuuccuug

SEQ ID NO: 2686 - RNA, 19 nt, Artificial Sequence
  Description of Artificial Sequence: Synthetic oligonucleotide
caaggaagguccaccacca

SEQ ID NO: 2687 - RNA, 19 nt, Artificial Sequence
  Description of Artificial Sequence: Synthetic oligonucleotide
ggugguggaccuuccuugg

SEQ ID NO: 2688 - RNA, 19 nt, Artificial Sequence
  Description of Artificial Sequence: Synthetic oligonucleotide
ccaaggaagguccaccacc

SEQ ID NO: 2689 - RNA, 19 nt, Artificial Sequence
  Description of Artificial Sequence: Synthetic oligonucleotide
gugguggaccuuccuuggu

SEQ ID NO: 2690 - RNA, 19 nt, Artificial Sequence
  Description of Artificial Sequence: Synthetic oligonucleotide
accaaggaagguccaccac

SEQ ID NO: 2691 - RNA, 19 nt, Artificial Sequence
  Description of Artificial Sequence: Synthetic oligonucleotide
ugguggaccuuccuugguu

SEQ ID NO: 2692 - RNA, 19 nt, Artificial Sequence
  Description of Artificial Sequence: Synthetic oligonucleotide
aaccaaggaagguccacca

SEQ ID NO: 2693 - RNA, 19 nt, Artificial Sequence
  Description of Artificial Sequence: Synthetic oligonucleotide
gguggaccuuccuugguuu

SEQ ID NO: 2694 - RNA, 19 nt, Artificial Sequence
  Description of Artificial Sequence: Synthetic oligonucleotide
aaaccaaggaagguccacc

SEQ ID NO: 2695 - RNA, 19 nt, Artificial Sequence
  Description of Artificial Sequence: Synthetic oligonucleotide
guggaccuuccuugguuuu

SEQ ID NO: 2696 - RNA, 19 nt, Artificial Sequence
  Description of Artificial Sequence: Synthetic oligonucleotide
aaaaccaaggaagguccac

SEQ ID NO: 2697 - RNA, 19 nt, Artificial Sequence
  Description of Artificial Sequence: Synthetic oligonucleotide
cauguauuuuagcauaagg

SEQ ID NO: 2698 - RNA, 19 nt, Artificial Sequence
  Description of Artificial Sequence: Synthetic oligonucleotide
ccuuaugcuaaaauacaug

SEQ ID NO: 2699 - RNA, 19 nt, Artificial Sequence
  Description of Artificial Sequence: Synthetic oligonucleotide
aaauguguaugaguuucag

SEQ ID NO: 2700 - RNA, 19 nt, Artificial Sequence
  Description of Artificial Sequence: Synthetic oligonucleotide
cugaaacucauacacauuu

SEQ ID NO: 2701 - RNA, 19 nt, Artificial Sequence
  Description of Artificial Sequence: Synthetic oligonucleotide
aauguguaugaguuucagu

SEQ ID NO: 2702 - RNA, 19 nt, Artificial Sequence
  Description of Artificial Sequence: Synthetic oligonucleotide
acugaaacucauacacauu

SEQ ID NO: 2703 - RNA, 19 nt, Artificial Sequence
  Description of Artificial Sequence: Synthetic oligonucleotide
auguguaugaguuucagua

SEQ ID NO: 2704 - RNA, 19 nt, Artificial Sequence
  Description of Artificial Sequence: Synthetic oligonucleotide
uacugaaacucauacacau

SEQ ID NO: 2705 - RNA, 19 nt, Artificial Sequence
  Description of Artificial Sequence: Synthetic oligonucleotide
guguaugaguuucaguaga

SEQ ID NO: 2706 - RNA, 19 nt, Artificial Sequence
  Description of Artificial Sequence: Synthetic oligonucleotide
ucuacugaaacucauacac

SEQ ID NO: 2707 - RNA, 19 nt, Artificial Sequence
  Description of Artificial Sequence: Synthetic oligonucleotide
uguaugaguuucaguagaa

SEQ ID NO: 2708 - RNA, 19 nt, Artificial Sequence
  Description of Artificial Sequence: Synthetic oligonucleotide
uucuacugaaacucauaca

SEQ ID NO: 2709 - RNA, 19 nt, Artificial Sequence
  Description of Artificial Sequence: Synthetic oligonucleotide
uuccauaaauaugcagagu

SEQ ID NO: 2710 - RNA, 19 nt, Artificial Sequence
  Description of Artificial Sequence: Synthetic oligonucleotide
acucugcauauuuauggaa

SEQ ID NO: 2711 - RNA, 19 nt, Artificial Sequence
  Description of Artificial Sequence: Synthetic oligonucleotide
ccauaaauaugcagaguuc

SEQ ID NO: 2712 - RNA, 19 nt, Artificial Sequence
  Description of Artificial Sequence: Synthetic oligonucleotide
gaacucugcauauuuaugg

SEQ ID NO: 2713 - RNA, 19 nt, Artificial Sequence
  Description of Artificial Sequence: Synthetic oligonucleotide
ugaaugcauuugcaauuuc

SEQ ID NO: 2714 - RNA, 19 nt, Artificial Sequence
  Description of Artificial Sequence: Synthetic oligonucleotide
gaaauugcaaaugcauuca

SEQ ID NO: 2715 - RNA, 19 nt, Artificial Sequence
  Description of Artificial Sequence: Synthetic oligonucleotide
gaaugcauuugcaauuucu

SEQ ID NO: 2716 - RNA, 19 nt, Artificial Sequence
  Description of Artificial Sequence: Synthetic oligonucleotide
agaaauugcaaaugcauuc

SEQ ID NO: 2717 - RNA, 19 nt, Artificial Sequence
  Description of Artificial Sequence: Synthetic oligonucleotide
augcauuugcaauuucuag

SEQ ID NO: 2718 - RNA, 19 nt, Artificial Sequence
  Description of Artificial Sequence: Synthetic oligonucleotide
cuagaaauugcaaaugcau

SEQ ID NO: 2719 - RNA, 19 nt, Artificial Sequence
  Description of Artificial Sequence: Synthetic oligonucleotide
ugcauuugcaauuucuagg

SEQ ID NO: 2720 - RNA, 19 nt, Artificial Sequence
  Description of Artificial Sequence: Synthetic oligonucleotide
ccuagaaauugcaaaugca

SEQ ID NO: 2721 - RNA, 19 nt, Artificial Sequence
  Description of Artificial Sequence: Synthetic oligonucleotide
gcauuugcaauuucuagga

SEQ ID NO: 2722 - RNA, 19 nt, Artificial Sequence
  Description of Artificial Sequence: Synthetic oligonucleotide
uccuagaaauugcaaaugc

SEQ ID NO: 2723 - RNA, 19 nt, Artificial Sequence
  Description of Artificial Sequence: Synthetic oligonucleotide
cauuugcaauuucuaggau

SEQ ID NO: 2724 - RNA, 19 nt, Artificial Sequence
  Description of Artificial Sequence: Synthetic oligonucleotide
auccuagaaauugcaaaug

SEQ ID NO: 2725 - RNA, 19 nt, Artificial Sequence
  Description of Artificial Sequence: Synthetic oligonucleotide
uuugcaauuucuaggauuc

SEQ ID NO: 2726 - RNA, 19 nt, Artificial Sequence
  Description of Artificial Sequence: Synthetic oligonucleotide
gaauccuagaaauugcaaa

SEQ ID NO: 2727 - RNA, 19 nt, Artificial Sequence
  Description of Artificial Sequence: Synthetic oligonucleotide
ugcaauuucuaggauucua

SEQ ID NO: 2728 - RNA, 19 nt, Artificial Sequence
  Description of Artificial Sequence: Synthetic oligonucleotide
uagaauccuagaaauugca

SEQ ID NO: 2729 - RNA, 19 nt, Artificial Sequence
  Description of Artificial Sequence: Synthetic oligonucleotide
gcaauuucuaggauucuaa

SEQ ID NO: 2730 - RNA, 19 nt, Artificial Sequence
  Description of Artificial Sequence: Synthetic oligonucleotide
uuagaauccuagaaauugc

SEQ ID NO: 2731 - RNA, 19 nt, Artificial Sequence
  Description of Artificial Sequence: Synthetic oligonucleotide
ucuaaagaauugaguacag

SEQ ID NO: 2732 - RNA, 19 nt, Artificial Sequence
  Description of Artificial Sequence: Synthetic oligonucleotide
cuguacucaauucuuuaga

SEQ ID NO: 2733 - RNA, 19 nt, Artificial Sequence
  Description of Artificial Sequence: Synthetic oligonucleotide
cuaaagaauugaguacaga

SEQ ID NO: 2734 - RNA, 19 nt, Artificial Sequence
  Description of Artificial Sequence: Synthetic oligonucleotide
ucuguacucaauucuuuag

SEQ ID NO: 2735 - RNA, 19 nt, Artificial Sequence
  Description of Artificial Sequence: Synthetic oligonucleotide
agaauuacugugccaauac

SEQ ID NO: 2736 - RNA, 19 nt, Artificial Sequence
  Description of Artificial Sequence: Synthetic oligonucleotide
guauuggcacaguaauucu

SEQ ID NO: 2737 - RNA, 19 nt, Artificial Sequence
  Description of Artificial Sequence: Synthetic oligonucleotide
gaauuacugugccaauacu

SEQ ID NO: 2738 - RNA, 19 nt, Artificial Sequence
  Description of Artificial Sequence: Synthetic oligonucleotide
aguauuggcacaguaauuc

SEQ ID NO: 2739 - RNA, 19 nt, Artificial Sequence
  Description of Artificial Sequence: Synthetic oligonucleotide
aauuacugugccaauacug

SEQ ID NO: 2740 - RNA, 19 nt, Artificial Sequence
  Description of Artificial Sequence: Synthetic oligonucleotide
caguauuggcacaguaauu

SEQ ID NO: 2741 - RNA, 19 nt, Artificial Sequence
  Description of Artificial Sequence: Synthetic oligonucleotide
cugugccaauacuguuuug

SEQ ID NO: 2742 - RNA, 19 nt, Artificial Sequence
  Description of Artificial Sequence: Synthetic oligonucleotide
caaaacaguauuggcacag

SEQ ID NO: 2743 - RNA, 19 nt, Artificial Sequence
  Description of Artificial Sequence: Synthetic oligonucleotide
ugugccaauacuguuuuga

SEQ ID NO: 2744 - RNA, 19 nt, Artificial Sequence
  Description of Artificial Sequence: Synthetic oligonucleotide
ucaaaacaguauuggcaca

SEQ ID NO: 2745 - RNA, 19 nt, Artificial Sequence
  Description of Artificial Sequence: Synthetic oligonucleotide
gugccaauacuguuuugau

SEQ ID NO: 2746 - RNA, 19 nt, Artificial Sequence
  Description of Artificial Sequence: Synthetic oligonucleotide
aucaaaacaguauuggcac

SEQ ID NO: 2747 - RNA, 19 nt, Artificial Sequence
  Description of Artificial Sequence: Synthetic oligonucleotide
gccaauacuguuuugauaa

SEQ ID NO: 2748 - RNA, 19 nt, Artificial Sequence
  Description of Artificial Sequence: Synthetic oligonucleotide
uuaucaaaacaguauuggc

SEQ ID NO: 2749 - RNA, 20 nt, Artificial Sequence
  Description of Artificial Sequence: Synthetic oligonucleotide
cgccuuucugaacgcggauc

SEQ ID NO: 2750 - RNA, 20 nt, Artificial Sequence
  Description of Artificial Sequence: Synthetic oligonucleotide
acgccuuucugaacgcggau

SEQ ID NO: 2751 - RNA, 20 nt, Artificial Sequence
  Description of Artificial Sequence: Synthetic oligonucleotide
cacgccuuucugaacgcgga

SEQ ID NO: 2752 - RNA, 20 nt, Artificial Sequence
  Description of Artificial Sequence: Synthetic oligonucleotide
ugcacgccuuucugaacgcg

SEQ ID NO: 2753 - RNA, 20 nt, Artificial Sequence
  Description of Artificial Sequence: Synthetic oligonucleotide
gaucaggcguaggaagugca

SEQ ID NO: 2754 - RNA, 20 nt, Artificial Sequence
  Description of Artificial Sequence: Synthetic oligonucleotide
ggaucaggcguaggaagugc

SEQ ID NO: 2755 - RNA, 20 nt, Artificial Sequence
  Description of Artificial Sequence: Synthetic oligonucleotide
gggaucaggcguaggaagug

SEQ ID NO: 2756 - RNA, 20 nt, Artificial Sequence
  Description of Artificial Sequence: Synthetic oligonucleotide
gaagcugcgagguugcgaug

SEQ ID NO: 2757 - RNA, 20 nt, Artificial Sequence
  Description of Artificial Sequence: Synthetic oligonucleotide
ggaagcugcgagguugcgau

SEQ ID NO: 2758 - RNA, 20 nt, Artificial Sequence
  Description of Artificial Sequence: Synthetic oligonucleotide
gggaauugguaaaugagcgc

SEQ ID NO: 2759 - RNA, 20 nt, Artificial Sequence
  Description of Artificial Sequence: Synthetic oligonucleotide
agggaauugguaaaugagcg

SEQ ID NO: 2760 - RNA, 20 nt, Artificial Sequence
  Description of Artificial Sequence: Synthetic oligonucleotide
gaagggaauugguaaaugag

SEQ ID NO: 2761 - RNA, 20 nt, Artificial Sequence
  Description of Artificial Sequence: Synthetic oligonucleotide
ggaagggaauugguaaauga

SEQ ID NO: 2762 - RNA, 20 nt, Artificial Sequence
  Description of Artificial Sequence: Synthetic oligonucleotide
ccaggaagggaauugguaaa

SEQ ID NO: 2763 - RNA, 20 nt, Artificial Sequence
  Description of Artificial Sequence: Synthetic oligonucleotide
cccaggaagggaauugguaa

SEQ ID NO: 2764 - RNA, 20 nt, Artificial Sequence
  Description of Artificial Sequence: Synthetic oligonucleotide
aagccgcaacucccaggaag

SEQ ID NO: 2765 - RNA, 20 nt, Artificial Sequence
  Description of Artificial Sequence: Synthetic oligonucleotide
gaagccgcaacucccaggaa

SEQ ID NO: 2766 - RNA, 20 nt, Artificial Sequence
  Description of Artificial Sequence: Synthetic oligonucleotide
aaaggguaaacgggaguggg

SEQ ID NO: 2767 - RNA, 20 nt, Artificial Sequence
  Description of Artificial Sequence: Synthetic oligonucleotide
gaaaggguaaacgggagugg

SEQ ID NO: 2768 - RNA, 20 nt, Artificial Sequence
  Description of Artificial Sequence: Synthetic oligonucleotide
ggaaaggguaaacgggagug

SEQ ID NO: 2769 - RNA, 20 nt, Artificial Sequence
  Description of Artificial Sequence: Synthetic oligonucleotide
gaaagugaaaguggagcccg

SEQ ID NO: 2770 - RNA, 20 nt, Artificial Sequence
  Description of Artificial Sequence: Synthetic oligonucleotide
ggaccgaaagugaaagugga

SEQ ID NO: 2771 - RNA, 20 nt, Artificial Sequence
  Description of Artificial Sequence: Synthetic oligonucleotide
aggaccgaaagugaaagugg

SEQ ID NO: 2772 - RNA, 20 nt, Artificial Sequence
  Description of Artificial Sequence: Synthetic oligonucleotide
caggaccgaaagugaaagug

SEQ ID NO: 2773 - RNA, 20 nt, Artificial Sequence
  Description of Artificial Sequence: Synthetic oligonucleotide
ccaggaccgaaagugaaagu

SEQ ID NO: 2774 - RNA, 20 nt, Artificial Sequence
  Description of Artificial Sequence: Synthetic oligonucleotide
ucuugcucuaccuaccuggg

SEQ ID NO: 2775 - RNA, 20 nt, Artificial Sequence
  Description of Artificial Sequence: Synthetic oligonucleotide
uucuugcucuaccuaccugg

SEQ ID NO: 2776 - RNA, 20 nt, Artificial Sequence
  Description of Artificial Sequence: Synthetic oligonucleotide
cuucuugcucuaccuaccug

SEQ ID NO: 2777 - RNA, 20 nt, Artificial Sequence
  Description of Artificial Sequence: Synthetic oligonucleotide
caccaucuucuugcucuacc

SEQ ID NO: 2778 - RNA, 20 nt, Artificial Sequence
  Description of Artificial Sequence: Synthetic oligonucleotide
acaccaucuucuugcucuac

SEQ ID NO: 2779 - RNA, 20 nt, Artificial Sequence
  Description of Artificial Sequence: Synthetic oligonucleotide
aacaccaucuucuugcucua

SEQ ID NO: 2780 - RNA, 20 nt, Artificial Sequence
  Description of Artificial Sequence: Synthetic oligonucleotide
aaacaccaucuucuugcucu

SEQ ID NO: 2781 - RNA, 20 nt, Artificial Sequence
  Description of Artificial Sequence: Synthetic oligonucleotide
guuaagagagccaacaguga

SEQ ID NO: 2782 - RNA, 20 nt, Artificial Sequence
  Description of Artificial Sequence: Synthetic oligonucleotide
aguuaagagagccaacagug

SEQ ID NO: 2783 - RNA, 20 nt, Artificial Sequence
  Description of Artificial Sequence: Synthetic oligonucleotide
acacaguuaagagagccaac

SEQ ID NO: 2784 - RNA, 20 nt, Artificial Sequence
  Description of Artificial Sequence: Synthetic oligonucleotide
uggacacaguuaagagagcc

SEQ ID NO: 2785 - RNA, 20 nt, Artificial Sequence
  Description of Artificial Sequence: Synthetic oligonucleotide
aguggacacaguuaagagag

SEQ ID NO: 2786 - RNA, 20 nt, Artificial Sequence
  Description of Artificial Sequence: Synthetic oligonucleotide
ugaaggaguggacacaguua

SEQ ID NO: 2787 - RNA, 20 nt, Artificial Sequence
  Description of Artificial Sequence: Synthetic oligonucleotide
augaaggaguggacacaguu

SEQ ID NO: 2788 - RNA, 20 nt, Artificial Sequence
  Description of Artificial Sequence: Synthetic oligonucleotide
accaugaaggaguggacaca

SEQ ID NO: 2789 - RNA, 20 nt, Artificial Sequence
  Description of Artificial Sequence: Synthetic oligonucleotide
acaccaugaaggaguggaca

SEQ ID NO: 2790 - RNA, 20 nt, Artificial Sequence
  Description of Artificial Sequence: Synthetic oligonucleotide
gacaccaugaaggaguggac

SEQ ID NO: 2791 - RNA, 20 nt, Artificial Sequence
  Description of Artificial Sequence: Synthetic oligonucleotide
ugacaccaugaaggagugga

SEQ ID NO: 2792 - RNA, 20 nt, Artificial Sequence
  Description of Artificial Sequence: Synthetic oligonucleotide
cugacaccaugaaggagugg

SEQ ID NO: 2793 - RNA, 20 nt, Artificial Sequence
  Description of Artificial Sequence: Synthetic oligonucleotide
cucugacaccaugaaggagu

SEQ ID NO: 2794 - RNA, 20 nt, Artificial Sequence
  Description of Artificial Sequence: Synthetic oligonucleotide
gcucugacaccaugaaggag

SEQ ID NO: 2795 - RNA, 20 nt, Artificial Sequence
  Description of Artificial Sequence: Synthetic oligonucleotide
ugcucugacaccaugaagga

SEQ ID NO: 2796 - RNA, 20 nt, Artificial Sequence
  Description of Artificial Sequence: Synthetic oligonucleotide
gugcucugacaccaugaagg

SEQ ID NO: 2797 - RNA, 20 nt, Artificial Sequence
  Description of Artificial Sequence: Synthetic oligonucleotide
ggagaugcuucagugcucug

SEQ ID NO: 2798 - RNA, 20 nt, Artificial Sequence
  Description of Artificial Sequence: Synthetic oligonucleotide
uggagaugcuucagugcucu

SEQ ID NO: 2799 - RNA, 20 nt, Artificial Sequence
  Description of Artificial Sequence: Synthetic oligonucleotide
guuuuggagaugcuucagug

SEQ ID NO: 2800 - RNA, 20 nt, Artificial Sequence
  Description of Artificial Sequence: Synthetic oligonucleotide
uacguuuuggagaugcuuca

SEQ ID NO: 2801 - RNA, 20 nt, Artificial Sequence
  Description of Artificial Sequence: Synthetic oligonucleotide
cuacguuuuggagaugcuuc

SEQ ID NO: 2802 - RNA, 20 nt, Artificial Sequence
  Description of Artificial Sequence: Synthetic oligonucleotide
acuacguuuuggagaugcuu

SEQ ID NO: 2803 - RNA, 20 nt, Artificial Sequence
  Description of Artificial Sequence: Synthetic oligonucleotide
cacuacguuuuggagaugcu

SEQ ID NO: 2804 - RNA, 20 nt, Artificial Sequence
  Description of Artificial Sequence: Synthetic oligonucleotide
aucacuacguuuuggagaug

SEQ ID NO: 2805 - RNA, 20 nt, Artificial Sequence
  Description of Artificial Sequence: Synthetic oligonucleotide
caucacuacguuuuggagau

SEQ ID NO: 2806 - RNA, 20 nt, Artificial Sequence
  Description of Artificial Sequence: Synthetic oligonucleotide
ccaucacuacguuuuggaga

SEQ ID NO: 2807 - RNA, 20 nt, Artificial Sequence
  Description of Artificial Sequence: Synthetic oligonucleotide
cccaucacuacguuuuggag

SEQ ID NO: 2808 - RNA, 20 nt, Artificial Sequence
  Description of Artificial Sequence: Synthetic oligonucleotide
ucccaucacuacguuuugga

SEQ ID NO: 2809 - RNA, 20 nt, Artificial Sequence
  Description of Artificial Sequence: Synthetic oligonucleotide
gucccaucacuacguuuugg

SEQ ID NO: 2810 - RNA, 20 nt, Artificial Sequence
  Description of Artificial Sequence: Synthetic oligonucleotide
ugucccaucacuacguuuug

SEQ ID NO: 2811 - RNA, 20 nt, Artificial Sequence
  Description of Artificial Sequence: Synthetic oligonucleotide
gugucccaucacuacguuuu

SEQ ID NO: 2812 - RNA, 20 nt, Artificial Sequence
  Description of Artificial Sequence: Synthetic oligonucleotide
ggugucccaucacuacguuu

SEQ ID NO: 2813 - RNA, 20 nt, Artificial Sequence
  Description of Artificial Sequence: Synthetic oligonucleotide
uggugucccaucacuacguu

SEQ ID NO: 2814 - RNA, 20 nt, Artificial Sequence
  Description of Artificial Sequence: Synthetic oligonucleotide
auuccaaggaaauggugucc

SEQ ID NO: 2815 - RNA, 20 nt, Artificial Sequence
  Description of Artificial Sequence: Synthetic oligonucleotide
uauuccaaggaaaugguguc

SEQ ID NO: 2816 - RNA, 20 nt, Artificial Sequence
  Description of Artificial Sequence: Synthetic oligonucleotide
gaucauaaugaacugggaug

SEQ ID NO: 2817 - RNA, 20 nt, Artificial Sequence
  Description of Artificial Sequence: Synthetic oligonucleotide
gagaucauaaugaacuggga

SEQ ID NO: 2818 - RNA, 20 nt, Artificial Sequence
  Description of Artificial Sequence: Synthetic oligonucleotide
agagaucauaaugaacuggg

SEQ ID NO: 2819 - RNA, 20 nt, Artificial Sequence
  Description of Artificial Sequence: Synthetic oligonucleotide
gucagcgugguaagguuugc

SEQ ID NO: 2820 - RNA, 20 nt, Artificial Sequence
  Description of Artificial Sequence: Synthetic oligonucleotide
ggucagcgugguaagguuug

SEQ ID NO: 2821 - RNA, 20 nt, Artificial Sequence
  Description of Artificial Sequence: Synthetic oligonucleotide
aggucagcgugguaagguuu

SEQ ID NO: 2822 - RNA, 20 nt, Artificial Sequence
  Description of Artificial Sequence: Synthetic oligonucleotide
aaggucagcgugguaagguu

SEQ ID NO: 2823 - RNA, 20 nt, Artificial Sequence
  Description of Artificial Sequence: Synthetic oligonucleotide
gaaggucagcgugguaaggu

SEQ ID NO: 2824 - RNA, 20 nt, Artificial Sequence
  Description of Artificial Sequence: Synthetic oligonucleotide
agaaggucagcgugguaagg

SEQ ID NO: 2825 - RNA, 20 nt, Artificial Sequence
  Description of Artificial Sequence: Synthetic oligonucleotide
ccagaaggucagcgugguaa

SEQ ID NO: 2826 - RNA, 20 nt, Artificial Sequence
  Description of Artificial Sequence: Synthetic oligonucleotide
cccagaaggucagcguggua

SEQ ID NO: 2827 - RNA, 20 nt, Artificial Sequence
  Description of Artificial Sequence: Synthetic oligonucleotide
uuucuacuuucgugguuccc

SEQ ID NO: 2828 - RNA, 20 nt, Artificial Sequence
  Description of Artificial Sequence: Synthetic oligonucleotide
auuucuacuuucgugguucc

SEQ ID NO: 2829 - RNA, 20 nt, Artificial Sequence
  Description of Artificial Sequence: Synthetic oligonucleotide
gauuucuacuuucgugguuc

SEQ ID NO: 2830 - RNA, 20 nt, Artificial Sequence
  Description of Artificial Sequence: Synthetic oligonucleotide
gugauuucuacuuucguggu

SEQ ID NO: 2831 - RNA, 20 nt, Artificial Sequence
  Description of Artificial Sequence: Synthetic oligonucleotide
acuggcugugauuucuacuu

SEQ ID NO: 2832 - RNA, 20 nt, Artificial Sequence
  Description of Artificial Sequence: Synthetic oligonucleotide
gacuggcugugauuucuacu

SEQ ID NO: 2833 - RNA, 20 nt, Artificial Sequence
  Description of Artificial Sequence: Synthetic oligonucleotide
cugacuggcugugauuucua

SEQ ID NO: 2834 - RNA, 20 nt, Artificial Sequence
  Description of Artificial Sequence: Synthetic oligonucleotide
ugcaggaugauggugcuggu

SEQ ID NO: 2835 - RNA, 20 nt, Artificial Sequence
  Description of Artificial Sequence: Synthetic oligonucleotide
augcaggaugauggugcugg

SEQ ID NO: 2836 - RNA, 20 nt, Artificial Sequence
  Description of Artificial Sequence: Synthetic oligonucleotide
cuaugcaggaugauggugcu

SEQ ID NO: 2837 - RNA, 20 nt, Artificial Sequence
  Description of Artificial Sequence: Synthetic oligonucleotide
ugacuaugcaggaugauggu

SEQ ID NO: 2838 - RNA, 20 nt, Artificial Sequence
  Description of Artificial Sequence: Synthetic oligonucleotide
gugacuaugcaggaugaugg

SEQ ID NO: 2839 - RNA, 20 nt, Artificial Sequence
  Description of Artificial Sequence: Synthetic oligonucleotide
ggugacuaugcaggaugaug

SEQ ID NO: 2840 - RNA, 20 nt, Artificial Sequence
  Description of Artificial Sequence: Synthetic oligonucleotide
uggugacuaugcaggaugau

SEQ ID NO: 2841 - RNA, 20 nt, Artificial Sequence
  Description of Artificial Sequence: Synthetic oligonucleotide
guggugacuaugcaggauga

SEQ ID NO: 2842 - RNA, 20 nt, Artificial Sequence
  Description of Artificial Sequence: Synthetic oligonucleotide
gguggugacuaugcaggaug

SEQ ID NO: 2843 - RNA, 20 nt, Artificial Sequence
  Description of Artificial Sequence: Synthetic oligonucleotide
agguggugacuaugcaggau

SEQ ID NO: 2844 - RNA, 20 nt, Artificial Sequence
  Description of Artificial Sequence: Synthetic oligonucleotide
cagguggugacuaugcagga

SEQ ID NO: 2845 - RNA, 20 nt, Artificial Sequence
  Description of Artificial Sequence: Synthetic oligonucleotide
gcagguggugacuaugcagg

SEQ ID NO: 2846 - RNA, 20 nt, Artificial Sequence
  Description of Artificial Sequence: Synthetic oligonucleotide
uccgauagccucucuccagc

SEQ ID NO: 2847 - RNA, 20 nt, Artificial Sequence
  Description of Artificial Sequence: Synthetic oligonucleotide
uuccgauagccucucuccag

SEQ ID NO: 2848 - RNA, 20 nt, Artificial Sequence
  Description of Artificial Sequence: Synthetic oligonucleotide
cuuccgauagccucucucca

SEQ ID NO: 2849 - RNA, 20 nt, Artificial Sequence
  Description of Artificial Sequence: Synthetic oligonucleotide
ucuuccgauagccucucucc

SEQ ID NO: 2850 - RNA, 20 nt, Artificial Sequence
  Description of Artificial Sequence: Synthetic oligonucleotide
uucuuccgauagccucucuc

SEQ ID NO: 2851 - RNA, 20 nt, Artificial Sequence
  Description of Artificial Sequence: Synthetic oligonucleotide
guucuuccgauagccucucu

SEQ ID NO: 2852 - RNA, 20 nt, Artificial Sequence
  Description of Artificial Sequence: Synthetic oligonucleotide
gguucuuccgauagccucuc

SEQ ID NO: 2853 - RNA, 20 nt, Artificial Sequence
  Description of Artificial Sequence: Synthetic oligonucleotide
ggguucuuccgauagccucu

SEQ ID NO: 2854 - RNA, 20 nt, Artificial Sequence
  Description of Artificial Sequence: Synthetic oligonucleotide
gagccagcagugcaauuugc

SEQ ID NO: 2855 - RNA, 20 nt, Artificial Sequence
  Description of Artificial Sequence: Synthetic oligonucleotide
ucgggagccagcagugcaau

SEQ ID NO: 2856 - RNA, 20 nt, Artificial Sequence
  Description of Artificial Sequence: Synthetic oligonucleotide
uguguacgggagcccgacaa

SEQ ID NO: 2857 - RNA, 20 nt, Artificial Sequence
  Description of Artificial Sequence: Synthetic oligonucleotide
aacuguguacgggagcccga

SEQ ID NO: 2858 - RNA, 20 nt, Artificial Sequence
  Description of Artificial Sequence: Synthetic oligonucleotide
acaacuguguacgggagccc

SEQ ID NO: 2859 - RNA, 20 nt, Artificial Sequence
  Description of Artificial Sequence: Synthetic oligonucleotide
gacaacuguguacgggagcc

SEQ ID NO: 2860 - RNA, 20 nt, Artificial Sequence
  Description of Artificial Sequence: Synthetic oligonucleotide
ugacaacuguguacgggagc

SEQ ID NO: 2861 - RNA, 20 nt, Artificial Sequence
  Description of Artificial Sequence: Synthetic oligonucleotide
augacaacuguguacgggag

SEQ ID NO: 2862 - RNA, 20 nt, Artificial Sequence
  Description of Artificial Sequence: Synthetic oligonucleotide
aaugacaacuguguacggga

SEQ ID NO: 2863 - RNA, 20 nt, Artificial Sequence
  Description of Artificial Sequence: Synthetic oligonucleotide
gaaugacaacuguguacggg

SEQ ID NO: 2864 - RNA, 20 nt, Artificial Sequence
  Description of Artificial Sequence: Synthetic oligonucleotide
gugaaugacaacuguguacg

SEQ ID NO: 2865 - RNA, 20 nt, Artificial Sequence
  Description of Artificial Sequence: Synthetic oligonucleotide
cauagugaaugacaacugug

SEQ ID NO: 2866 - RNA, 20 nt, Artificial Sequence
  Description of Artificial Sequence: Synthetic oligonucleotide
gcauagugaaugacaacugu

SEQ ID NO: 2867 - RNA, 20 nt, Artificial Sequence
  Description of Artificial Sequence: Synthetic oligonucleotide
agcauagugaaugacaacug

SEQ ID NO: 2868 - RNA, 20 nt, Artificial Sequence
  Description of Artificial Sequence: Synthetic oligonucleotide
cagcauagugaaugacaacu

SEQ ID NO: 2869 - RNA, 20 nt, Artificial Sequence
  Description of Artificial Sequence: Synthetic oligonucleotide
ccagcauagugaaugacaac

SEQ ID NO: 2870 - RNA, 20 nt, Artificial Sequence
  Description of Artificial Sequence: Synthetic oligonucleotide
gccagcauagugaaugacaa

SEQ ID NO: 2871 - RNA, 20 nt, Artificial Sequence
  Description of Artificial Sequence: Synthetic oligonucleotide
ugccagcauagugaaugaca

SEQ ID NO: 2872 - RNA, 20 nt, Artificial Sequence
  Description of Artificial Sequence: Synthetic oligonucleotide
uugccagcauagugaaugac

SEQ ID NO: 2873 - RNA, 20 nt, Artificial Sequence
  Description of Artificial Sequence: Synthetic oligonucleotide
aaagauugccagcauaguga

SEQ ID NO: 2874 - RNA, 20 nt, Artificial Sequence
  Description of Artificial Sequence: Synthetic oligonucleotide
gaaagauugccagcauagug

SEQ ID NO: 2875 - RNA, 20 nt, Artificial Sequence
  Description of Artificial Sequence: Synthetic oligonucleotide
uaaaauccguggaaagucuc

SEQ ID NO: 2876 - RNA, 20 nt, Artificial Sequence
  Description of Artificial Sequence: Synthetic oligonucleotide
guaaaauccguggaaagucu

SEQ ID NO: 2877 - RNA, 20 nt, Artificial Sequence
  Description of Artificial Sequence: Synthetic oligonucleotide
uguaaaauccguggaaaguc

SEQ ID NO: 2878 - RNA, 20 nt, Artificial Sequence
  Description of Artificial Sequence: Synthetic oligonucleotide
gcuuuuguaaaauccgugga

SEQ ID NO: 2879 - RNA, 20 nt, Artificial Sequence
  Description of Artificial Sequence: Synthetic oligonucleotide
ugcuuuuguaaaauccgugg

SEQ ID NO: 2880 - RNA, 20 nt, Artificial Sequence
  Description of Artificial Sequence: Synthetic oligonucleotide
aggugcuuuuguaaaauccg

SEQ ID NO: 2881 - RNA, 20 nt, Artificial Sequence
  Description of Artificial Sequence: Synthetic oligonucleotide
guucuguaggugcuuuugua

SEQ ID NO: 2882 - RNA, 20 nt, Artificial Sequence
  Description of Artificial Sequence: Synthetic oligonucleotide
gguucuguaggugcuuuugu

SEQ ID NO: 2883 - RNA, 20 nt, Artificial Sequence
  Description of Artificial Sequence: Synthetic oligonucleotide
uuccuugguucuguaggugc

SEQ ID NO: 2884 - RNA, 20 nt, Artificial Sequence
  Description of Artificial Sequence: Synthetic oligonucleotide
cuuccuugguucuguaggug

SEQ ID NO: 2885 - RNA, 20 nt, Artificial Sequence
  Description of Artificial Sequence: Synthetic oligonucleotide
cccuuccuugguucuguagg

SEQ ID NO: 2886 - RNA, 20 nt, Artificial Sequence
  Description of Artificial Sequence: Synthetic oligonucleotide
ugcuaguauccucaguuccc

SEQ ID NO: 2887 - RNA, 20 nt, Artificial Sequence
  Description of Artificial Sequence: Synthetic oligonucleotide
augcuaguauccucaguucc

SEQ ID NO: 2888 - RNA, 20 nt, Artificial Sequence
  Description of Artificial Sequence: Synthetic oligonucleotide
gaugcuaguauccucaguuc

SEQ ID NO: 2889 - RNA, 20 nt, Artificial Sequence
  Description of Artificial Sequence: Synthetic oligonucleotide
ugaugcuaguauccucaguu

SEQ ID NO: 2890 - RNA, 20 nt, Artificial Sequence
  Description of Artificial Sequence: Synthetic oligonucleotide
uugaugcuaguauccucagu

SEQ ID NO: 2891 - RNA, 20 nt, Artificial Sequence
  Description of Artificial Sequence: Synthetic oligonucleotide
guugaugcuaguauccucag

SEQ ID NO: 2892 - RNA, 20 nt, Artificial Sequence
  Description of Artificial Sequence: Synthetic oligonucleotide
uguugaugcuaguauccuca

SEQ ID NO: 2893 - RNA, 20 nt, Artificial Sequence
  Description of Artificial Sequence: Synthetic oligonucleotide
guguugaugcuaguauccuc

SEQ ID NO: 2894 - RNA, 20 nt, Artificial Sequence
  Description of Artificial Sequence: Synthetic oligonucleotide
agggaaaggccauucuagcu

SEQ ID NO: 2895 - RNA, 20 nt, Artificial Sequence
  Description of Artificial Sequence: Synthetic oligonucleotide
cagggaaaggccauucuagc

SEQ ID NO: 2896 - RNA, 20 nt, Artificial Sequence
  Description of Artificial Sequence: Synthetic oligonucleotide
aaagcagggaaaggccauuc

SEQ ID NO: 2897 - RNA, 20 nt, Artificial Sequence
  Description of Artificial Sequence: Synthetic oligonucleotide
caucaaagcagggaaaggcc

SEQ ID NO: 2898 - RNA, 20 nt, Artificial Sequence
  Description of Artificial Sequence: Synthetic oligonucleotide
guucaucaaagcagggaaag

SEQ ID NO: 2899 - RNA, 20 nt, Artificial Sequence
  Description of Artificial Sequence: Synthetic oligonucleotide
cagguucaucaaagcaggga

SEQ ID NO: 2900 - RNA, 20 nt, Artificial Sequence
  Description of Artificial Sequence: Synthetic oligonucleotide
aggcagguucaucaaagcag

SEQ ID NO: 2901 - RNA, 20 nt, Artificial Sequence
  Description of Artificial Sequence: Synthetic oligonucleotide
aaggcagguucaucaaagca

SEQ ID NO: 2902 - RNA, 20 nt, Artificial Sequence
  Description of Artificial Sequence: Synthetic oligonucleotide
gaaggcagguucaucaaagc

SEQ ID NO: 2903 - RNA, 20 nt, Artificial Sequence
  Description of Artificial Sequence: Synthetic oligonucleotide
aaacuugcuuugaaggcagg

SEQ ID NO: 2904 - RNA, 20 nt, Artificial Sequence
  Description of Artificial Sequence: Synthetic oligonucleotide
gaaacuugcuuugaaggcag

SEQ ID NO: 2905 - RNA, 20 nt, Artificial Sequence
  Description of Artificial Sequence: Synthetic oligonucleotide
agaaacuugcuuugaaggca

SEQ ID NO: 2906 - RNA, 20 nt, Artificial Sequence
  Description of Artificial Sequence: Synthetic oligonucleotide
ugccuuggcucucuucuaau

SEQ ID NO: 2907 - RNA, 20 nt, Artificial Sequence
  Description of Artificial Sequence: Synthetic oligonucleotide
gugccuuggcucucuucuaa

SEQ ID NO: 2908 - RNA, 20 nt, Artificial Sequence
  Description of Artificial Sequence: Synthetic oligonucleotide
uaggugccuuggcucucuuc

SEQ ID NO: 2909 - RNA, 20 nt, Artificial Sequence
  Description of Artificial Sequence: Synthetic oligonucleotide
uggcuaggugccuuggcucu

SEQ ID NO: 2910 - RNA, 20 nt, Artificial Sequence
  Description of Artificial Sequence: Synthetic oligonucleotide
auggcuaggugccuuggcuc

SEQ ID NO: 2911 - RNA, 20 nt, Artificial Sequence
  Description of Artificial Sequence: Synthetic oligonucleotide
gauggcuaggugccuuggcu

SEQ ID NO: 2912 - RNA, 20 nt, Artificial Sequence
  Description of Artificial Sequence: Synthetic oligonucleotide
agauggcuaggugccuuggc

SEQ ID NO: 2913 - RNA, 20 nt, Artificial Sequence
  Description of Artificial Sequence: Synthetic oligonucleotide
gagauggcuaggugccuugg

SEQ ID NO: 2914 - RNA, 20 nt, Artificial Sequence
  Description of Artificial Sequence: Synthetic oligonucleotide
ggagauggcuaggugccuug

SEQ ID NO: 2915 - RNA, 20 nt, Artificial Sequence
  Description of Artificial Sequence: Synthetic oligonucleotide
uuggagauggcuaggugccu

SEQ ID NO: 2916 - RNA, 20 nt, Artificial Sequence
  Description of Artificial Sequence: Synthetic oligonucleotide
auuggagauggcuaggugcc

SEQ ID NO: 2917 - RNA, 20 nt, Artificial Sequence
  Description of Artificial Sequence: Synthetic oligonucleotide
uauuggagauggcuaggugc

SEQ ID NO: 2918 - RNA, 20 nt, Artificial Sequence
  Description of Artificial Sequence: Synthetic oligonucleotide
cauauuggagauggcuaggu

SEQ ID NO: 2919 - RNA, 20 nt, Artificial Sequence
  Description of Artificial Sequence: Synthetic oligonucleotide
gcauauuggagauggcuagg

SEQ ID NO: 2920 - RNA, 20 nt, Artificial Sequence
  Description of Artificial Sequence: Synthetic oligonucleotide
ggcauauuggagauggcuag

SEQ ID NO: 2921 - RNA, 20 nt, Artificial Sequence
  Description of Artificial Sequence: Synthetic oligonucleotide
auggcauauuggagauggcu

SEQ ID NO: 2922 - RNA, 20 nt, Artificial Sequence
  Description of Artificial Sequence: Synthetic oligonucleotide
cagauuucaccaauggcaua

SEQ ID NO: 2923 - RNA, 20 nt, Artificial Sequence
  Description of Artificial Sequence: Synthetic oligonucleotide
acagauuucaccaauggcau

SEQ ID NO: 2924 - RNA, 20 nt, Artificial Sequence
  Description of Artificial Sequence: Synthetic oligonucleotide
cacagauuucaccaauggca

SEQ ID NO: 2925 - RNA, 20 nt, Artificial Sequence
  Description of Artificial Sequence: Synthetic oligonucleotide
ucacagauuucaccaauggc

SEQ ID NO: 2926 - RNA, 20 nt, Artificial Sequence
  Description of Artificial Sequence: Synthetic oligonucleotide
gucacagauuucaccaaugg

SEQ ID NO: 2927 - RNA, 20 nt, Artificial Sequence
  Description of Artificial Sequence: Synthetic oligonucleotide
agucacagauuucaccaaug

SEQ ID NO: 2928 - RNA, 20 nt, Artificial Sequence
  Description of Artificial Sequence: Synthetic oligonucleotide
cagucacagauuucaccaau

SEQ ID NO: 2929 - RNA, 20 nt, Artificial Sequence
  Description of Artificial Sequence: Synthetic oligonucleotide
acagucacagauuucaccaa

SEQ ID NO: 2930 - RNA, 20 nt, Artificial Sequence
  Description of Artificial Sequence: Synthetic oligonucleotide
uucagcaacagucacagauu

SEQ ID NO: 2931 - RNA, 20 nt, Artificial Sequence
  Description of Artificial Sequence: Synthetic oligonucleotide
cuucagcaacagucacagau

SEQ ID NO: 2932 - RNA, 20 nt, Artificial Sequence
  Description of Artificial Sequence: Synthetic oligonucleotide
guccuucagcaacagucaca

SEQ ID NO: 2933 - RNA, 20 nt, Artificial Sequence
  Description of Artificial Sequence: Synthetic oligonucleotide
aguccuucagcaacagucac

SEQ ID NO: 2934 - RNA, 20 nt, Artificial Sequence
  Description of Artificial Sequence: Synthetic oligonucleotide
gaguccuucagcaacaguca

SEQ ID NO: 2935 - RNA, 20 nt, Artificial Sequence
  Description of Artificial Sequence: Synthetic oligonucleotide
cuaugaguccuucagcaaca

SEQ ID NO: 2936 - RNA, 20 nt, Artificial Sequence
  Description of Artificial Sequence: Synthetic oligonucleotide
ucuaugaguccuucagcaac

SEQ ID NO: 2937 - RNA, 20 nt, Artificial Sequence
  Description of Artificial Sequence: Synthetic oligonucleotide
uucuaugaguccuucagcaa

SEQ ID NO: 2938 - RNA, 20 nt, Artificial Sequence
  Description of Artificial Sequence: Synthetic oligonucleotide
cuucuaugaguccuucagca

SEQ ID NO: 2939 - RNA, 20 nt, Artificial Sequence
  Description of Artificial Sequence: Synthetic oligonucleotide
gucuucuaugaguccuucag

SEQ ID NO: 2940 - RNA, 20 nt, Artificial Sequence
  Description of Artificial Sequence: Synthetic oligonucleotide
aauggucuucuaugaguccu

SEQ ID NO: 2941 - RNA, 20 nt, Artificial Sequence
  Description of Artificial Sequence: Synthetic oligonucleotide
aaauggucuucuaugagucc

SEQ ID NO: 2942 - RNA, 20 nt, Artificial Sequence
  Description of Artificial Sequence: Synthetic oligonucleotide
ucacagugacaucaaaaugg

SEQ ID NO: 2943 - RNA, 20 nt, Artificial Sequence
  Description of Artificial Sequence: Synthetic oligonucleotide
ucaucuucacagugacauca

SEQ ID NO: 2944 - RNA, 20 nt, Artificial Sequence
  Description of Artificial Sequence: Synthetic oligonucleotide
gcucaucuucacagugacau

SEQ ID NO: 2945 - RNA, 20 nt, Artificial Sequence
  Description of Artificial Sequence: Synthetic oligonucleotide
ugcucaucuucacagugaca

SEQ ID NO: 2946 - RNA, 20 nt, Artificial Sequence
  Description of Artificial Sequence: Synthetic oligonucleotide
ggugcucaucuucacaguga

SEQ ID NO: 2947 - RNA, 20 nt, Artificial Sequence
  Description of Artificial Sequence: Synthetic oligonucleotide
aggugcucaucuucacagug

SEQ ID NO: 2948 - RNA, 20 nt, Artificial Sequence
  Description of Artificial Sequence: Synthetic oligonucleotide
auaggugcucaucuucacag

SEQ ID NO: 2949 - RNA, 20 nt, Artificial Sequence
  Description of Artificial Sequence: Synthetic oligonucleotide
gauaggugcucaucuucaca

SEQ ID NO: 2950 - RNA, 20 nt, Artificial Sequence
  Description of Artificial Sequence: Synthetic oligonucleotide
augaaggccaccagauaggu

SEQ ID NO: 2951 - RNA, 20 nt, Artificial Sequence
  Description of Artificial Sequence: Synthetic oligonucleotide
ugaugaaggccaccagauag

SEQ ID NO: 2952 - RNA, 20 nt, Artificial Sequence
  Description of Artificial Sequence: Synthetic oligonucleotide
augaugaaggccaccagaua

SEQ ID NO: 2953 - RNA, 20 nt, Artificial Sequence
  Description of Artificial Sequence: Synthetic oligonucleotide
aaugaugaaggccaccagau

SEQ ID NO: 2954 - RNA, 20 nt, Artificial Sequence
  Description of Artificial Sequence: Synthetic oligonucleotide
gaaaugaugaaggccaccag

SEQ ID NO: 2955 - RNA, 20 nt, Artificial Sequence
  Description of Artificial Sequence: Synthetic oligonucleotide
ugaaaugaugaaggccacca

SEQ ID NO: 2956 - RNA, 20 nt, Artificial Sequence
  Description of Artificial Sequence: Synthetic oligonucleotide
ugcugacagacucaaaaucu

SEQ ID NO: 2957 - RNA, 20 nt, Artificial Sequence
  Description of Artificial Sequence: Synthetic oligonucleotide
ucuugcugacagacucaaaa

SEQ ID NO: 2958 - RNA, 20 nt, Artificial Sequence
  Description of Artificial Sequence: Synthetic oligonucleotide
guuaucuugcugacagacuc

SEQ ID NO: 2959 - RNA, 20 nt, Artificial Sequence
  Description of Artificial Sequence: Synthetic oligonucleotide
gguuaucuugcugacagacu

SEQ ID NO: 2960 - RNA, 20 nt, Artificial Sequence
  Description of Artificial Sequence: Synthetic oligonucleotide
ugguuaucuugcugacagac

SEQ ID NO: 2961 - RNA, 20 nt, Artificial Sequence
  Description of Artificial Sequence: Synthetic oligonucleotide
cuugguuaucuugcugacag

SEQ ID NO: 2962 - RNA, 20 nt, Artificial Sequence
  Description of Artificial Sequence: Synthetic oligonucleotide
cucuugguuaucuugcugac

SEQ ID NO: 2963 - RNA, 20 nt, Artificial Sequence
  Description of Artificial Sequence: Synthetic oligonucleotide
acucuugguuaucuugcuga

SEQ ID NO: 2964 - RNA, 20 nt, Artificial Sequence
  Description of Artificial Sequence: Synthetic oligonucleotide
cacucuugguuaucuugcug

SEQ ID NO: 2965 - RNA, 20 nt, Artificial Sequence
  Description of Artificial Sequence: Synthetic oligonucleotide
ccacucuugguuaucuugcu

SEQ ID NO: 2966 - RNA, 20 nt, Artificial Sequence
  Description of Artificial Sequence: Synthetic oligonucleotide
gacuccacucuugguuaucu

SEQ ID NO: 2967 - RNA, 20 nt, Artificial Sequence
  Description of Artificial Sequence: Synthetic oligonucleotide
ugacuccacucuugguuauc

SEQ ID NO: 2968 - RNA, 20 nt, Artificial Sequence
  Description of Artificial Sequence: Synthetic oligonucleotide
uugacuccacucuugguuau

SEQ ID NO: 2969 - RNA, 20 nt, Artificial Sequence
  Description of Artificial Sequence: Synthetic oligonucleotide
cuugacuccacucuugguua

SEQ ID NO: 2970 - RNA, 20 nt, Artificial Sequence
  Description of Artificial Sequence: Synthetic oligonucleotide
accuugacuccacucuuggu

SEQ ID NO: 2971 - RNA, 20 nt, Artificial Sequence
  Description of Artificial Sequence: Synthetic oligonucleotide
aaccuugacuccacucuugg

SEQ ID NO: 2972 - RNA, 20 nt, Artificial Sequence
  Description of Artificial Sequence: Synthetic oligonucleotide
aaaccuugacuccacucuug

SEQ ID NO: 2973 - RNA, 20 nt, Artificial Sequence
  Description of Artificial Sequence: Synthetic oligonucleotide
agaaaccuugacuccacucu

SEQ ID NO: 2974 - RNA, 20 nt, Artificial Sequence
  Description of Artificial Sequence: Synthetic oligonucleotide
cagaaaccuugacuccacuc

SEQ ID NO: 2975 - RNA, 20 nt, Artificial Sequence
  Description of Artificial Sequence: Synthetic oligonucleotide
aaacagaaaccuugacucca

SEQ ID NO: 2976 - RNA, 20 nt, Artificial Sequence
  Description of Artificial Sequence: Synthetic oligonucleotide
uaaacagaaaccuugacucc

SEQ ID NO: 2977 - RNA, 20 nt, Artificial Sequence
  Description of Artificial Sequence: Synthetic oligonucleotide
gcauaaacagaaaccuugac

SEQ ID NO: 2978 - RNA, 20 nt, Artificial Sequence
  Description of Artificial Sequence: Synthetic oligonucleotide
cagcauaaacagaaaccuug

SEQ ID NO: 2979 - RNA, 20 nt, Artificial Sequence
  Description of Artificial Sequence: Synthetic oligonucleotide
ucuugucuggcacagcauaa

SEQ ID NO: 2980 - RNA, 20 nt, Artificial Sequence
  Description of Artificial Sequence: Synthetic oligonucleotide
cagugcauaaucugcuugau

SEQ ID NO: 2981 - RNA, 20 nt, Artificial Sequence
  Description of Artificial Sequence: Synthetic oligonucleotide
ccagugcauaaucugcuuga

SEQ ID NO: 2982 - RNA, 20 nt, Artificial Sequence
  Description of Artificial Sequence: Synthetic oligonucleotide
uccagugcauaaucugcuug

SEQ ID NO: 2983 - RNA, 20 nt, Artificial Sequence
  Description of Artificial Sequence: Synthetic oligonucleotide
auccagugcauaaucugcuu

SEQ ID NO: 2984 - RNA, 20 nt, Artificial Sequence
  Description of Artificial Sequence: Synthetic oligonucleotide
cauccagugcauaaucugcu

SEQ ID NO: 2985 - RNA, 20 nt, Artificial Sequence
  Description of Artificial Sequence: Synthetic oligonucleotide
gcauccagugcauaaucugc

SEQ ID NO: 2986 - RNA, 20 nt, Artificial Sequence
  Description of Artificial Sequence: Synthetic oligonucleotide
agcauccagugcauaaucug

SEQ ID NO: 2987 - RNA, 20 nt, Artificial Sequence
  Description of Artificial Sequence: Synthetic oligonucleotide
cgcagcauccagugcauaau

SEQ ID NO: 2988 - RNA, 20 nt, Artificial Sequence
  Description of Artificial Sequence: Synthetic oligonucleotide
caccgcagcauccagugcau

SEQ ID NO: 2989 - RNA, 20 nt, Artificial Sequence
  Description of Artificial Sequence: Synthetic oligonucleotide
ucaccgcagcauccagugca

SEQ ID NO: 2990 - RNA, 20 nt, Artificial Sequence
  Description of Artificial Sequence: Synthetic oligonucleotide
agucaccgcagcauccagug

SEQ ID NO: 2991 - RNA, 20 nt, Artificial Sequence
  Description of Artificial Sequence: Synthetic oligonucleotide
gagucaccgcagcauccagu

SEQ ID NO: 2992 - RNA, 20 nt, Artificial Sequence
  Description of Artificial Sequence: Synthetic oligonucleotide
agagucaccgcagcauccag

SEQ ID NO: 2993 - RNA, 20 nt, Artificial Sequence
  Description of Artificial Sequence: Synthetic oligonucleotide
aagagucaccgcagcaucca

SEQ ID NO: 2994 - RNA, 20 nt, Artificial Sequence
  Description of Artificial Sequence: Synthetic oligonucleotide
gaagagucaccgcagcaucc

SEQ ID NO: 2995 - RNA, 20 nt, Artificial Sequence
  Description of Artificial Sequence: Synthetic oligonucleotide
agaagagucaccgcagcauc

SEQ ID NO: 2996 - RNA, 20 nt, Artificial Sequence
  Description of Artificial Sequence: Synthetic oligonucleotide
uagaagagucaccgcagcau

SEQ ID NO: 2997 - RNA, 20 nt, Artificial Sequence
  Description of Artificial Sequence: Synthetic oligonucleotide
cuagaagagucaccgcagca

SEQ ID NO: 2998 - RNA, 20 nt, Artificial Sequence
  Description of Artificial Sequence: Synthetic oligonucleotide
ucgggaauagcagcaagauc

SEQ ID NO: 2999 - RNA, 20 nt, Artificial Sequence
  Description of Artificial Sequence: Synthetic oligonucleotide
aagucgggaauagcagcaag

SEQ ID NO: 3000 - RNA, 20 nt, Artificial Sequence
  Description of Artificial Sequence: Synthetic oligonucleotide
aaagucgggaauagcagcaa

SEQ ID NO: 3001 - RNA, 20 nt, Artificial Sequence
  Description of Artificial Sequence: Synthetic oligonucleotide
gaaagucgggaauagcagca

SEQ ID NO: 3002 - RNA, 20 nt, Artificial Sequence
  Description of Artificial Sequence: Synthetic oligonucleotide
ugaaagucgggaauagcagc

SEQ ID NO: 3003 - RNA, 20 nt, Artificial Sequence
  Description of Artificial Sequence: Synthetic oligonucleotide
cugaaagucgggaauagcag

SEQ ID NO: 3004 - RNA, 20 nt, Artificial Sequence
  Description of Artificial Sequence: Synthetic oligonucleotide
acugaaagucgggaauagca

SEQ ID NO: 3005 - RNA, 20 nt, Artificial Sequence
  Description of Artificial Sequence: Synthetic oligonucleotide
cauagcaccagacugaaagu

SEQ ID NO: 3006 - RNA, 20 nt, Artificial Sequence
  Description of Artificial Sequence: Synthetic oligonucleotide
uccauagcaccagacugaaa

SEQ ID NO: 3007 - RNA, 20 nt, Artificial Sequence
  Description of Artificial Sequence: Synthetic oligonucleotide
uuccauagcaccagacugaa

SEQ ID NO: 3008 - RNA, 20 nt, Artificial Sequence
  Description of Artificial Sequence: Synthetic oligonucleotide
uuuccauagcaccagacuga

SEQ ID NO: 3009 - RNA, 20 nt, Artificial Sequence
  Description of Artificial Sequence: Synthetic oligonucleotide
uuuuccauagcaccagacug

SEQ ID NO: 3010 - RNA, 20 nt, Artificial Sequence
  Description of Artificial Sequence: Synthetic oligonucleotide
guuuuccauagcaccagacu

SEQ ID NO: 3011 - RNA, 20 nt, Artificial Sequence
  Description of Artificial Sequence: Synthetic oligonucleotide
aguuuuccauagcaccagac

SEQ ID NO: 3012 - RNA, 20 nt, Artificial Sequence
  Description of Artificial Sequence: Synthetic oligonucleotide
caguuuuccauagcaccaga

SEQ ID NO: 3013 - RNA, 20 nt, Artificial Sequence
  Description of Artificial Sequence: Synthetic oligonucleotide
ccaguuuuccauagcaccag

SEQ ID NO: 3014 - RNA, 20 nt, Artificial Sequence
  Description of Artificial Sequence: Synthetic oligonucleotide
cucuauauguugucaguccc

SEQ ID NO: 3015 - RNA, 20 nt, Artificial Sequence
  Description of Artificial Sequence: Synthetic oligonucleotide
cuugaugcagaagacuuuuc

SEQ ID NO: 3016 - RNA, 20 nt, Artificial Sequence
  Description of Artificial Sequence: Synthetic oligonucleotide
gcuuacuugaugcagaagac

SEQ ID NO: 3017 - RNA, 20 nt, Artificial Sequence
  Description of Artificial Sequence: Synthetic oligonucleotide
caguucaugggccacaguca

SEQ ID NO: 3018 - RNA, 20 nt, Artificial Sequence
  Description of Artificial Sequence: Synthetic oligonucleotide
gccaguucaugggccacagu

SEQ ID NO: 3019 - RNA, 20 nt, Artificial Sequence
  Description of Artificial Sequence: Synthetic oligonucleotide
uagugaccagguucccaaac

SEQ ID NO: 3020 - RNA, 20 nt, Artificial Sequence
  Description of Artificial Sequence: Synthetic oligonucleotide
auagugaccagguucccaaa

SEQ ID NO: 3021 - RNA, 20 nt, Artificial Sequence
  Description of Artificial Sequence: Synthetic oligonucleotide
uccauagugaccagguuccc

SEQ ID NO: 3022 - RNA, 20 nt, Artificial Sequence
  Description of Artificial Sequence: Synthetic oligonucleotide
uuccauagugaccagguucc

SEQ ID NO: 3023 - RNA, 20 nt, Artificial Sequence
  Description of Artificial Sequence: Synthetic oligonucleotide
auuccauagugaccagguuc

SEQ ID NO: 3024 - RNA, 20 nt, Artificial Sequence
  Description of Artificial Sequence: Synthetic oligonucleotide
cauuccauagugaccagguu

SEQ ID NO: 3025 - RNA, 20 nt, Artificial Sequence
  Description of Artificial Sequence: Synthetic oligonucleotide
ccauuccauagugaccaggu

SEQ ID NO: 3026 - RNA, 20 nt, Artificial Sequence
  Description of Artificial Sequence: Synthetic oligonucleotide
accauuccauagugaccagg

SEQ ID NO: 3027 - RNA, 20 nt, Artificial Sequence
  Description of Artificial Sequence: Synthetic oligonucleotide
caccauuccauagugaccag

SEQ ID NO: 3028 - RNA, 20 nt, Artificial Sequence
  Description of Artificial Sequence: Synthetic oligonucleotide
ccaccauuccauagugacca

SEQ ID NO: 3029 - RNA, 20 nt, Artificial Sequence
  Description of Artificial Sequence: Synthetic oligonucleotide
uccaccauuccauagugacc

SEQ ID NO: 3030 - RNA, 20 nt, Artificial Sequence
  Description of Artificial Sequence: Synthetic oligonucleotide
auuccaccauuccauaguga

SEQ ID NO: 3031 - RNA, 20 nt, Artificial Sequence
  Description of Artificial Sequence: Synthetic oligonucleotide
aucauuccaccauuccauag

SEQ ID NO: 3032 - RNA, 20 nt, Artificial Sequence
  Description of Artificial Sequence: Synthetic oligonucleotide
gaucauuccaccauuccaua

SEQ ID NO: 3033 - RNA, 20 nt, Artificial Sequence
  Description of Artificial Sequence: Synthetic oligonucleotide
aagaucauuccaccauucca

SEQ ID NO: 3034 - RNA, 20 nt, Artificial Sequence
  Description of Artificial Sequence: Synthetic oligonucleotide
aaagaucauuccaccauucc

SEQ ID NO: 3035 - RNA, 20 nt, Artificial Sequence
  Description of Artificial Sequence: Synthetic oligonucleotide
caaagaucauuccaccauuc

SEQ ID NO: 3036 - RNA, 20 nt, Artificial Sequence
  Description of Artificial Sequence: Synthetic oligonucleotide
ccaaagaucauuccaccauu

SEQ ID NO: 3037 - RNA, 20 nt, Artificial Sequence
  Description of Artificial Sequence: Synthetic oligonucleotide
gccaaagaucauuccaccau

SEQ ID NO: 3038 - RNA, 20 nt, Artificial Sequence
  Description of Artificial Sequence: Synthetic oligonucleotide
agccaaagaucauuccacca

SEQ ID NO: 3039 - RNA, 20 nt, Artificial Sequence
  Description of Artificial Sequence: Synthetic oligonucleotide
uagccaaagaucauuccacc

SEQ ID NO: 3040 - RNA, 20 nt, Artificial Sequence
  Description of Artificial Sequence: Synthetic oligonucleotide
gacagacacaaacuccauaa

SEQ ID NO: 3041 - RNA, 20 nt, Artificial Sequence
  Description of Artificial Sequence: Synthetic oligonucleotide
guucaggaugggucacacug

SEQ ID NO: 3042 - RNA, 20 nt, Artificial Sequence
  Description of Artificial Sequence: Synthetic oligonucleotide
aguucaggaugggucacacu

SEQ ID NO: 3043 - RNA, 20 nt, Artificial Sequence
  Description of Artificial Sequence: Synthetic oligonucleotide
caguucaggaugggucacac

SEQ ID NO: 3044 - RNA, 20 nt, Artificial Sequence
  Description of Artificial Sequence: Synthetic oligonucleotide
ucaguucaggaugggucaca

SEQ ID NO: 3045 - RNA, 20 nt, Artificial Sequence
  Description of Artificial Sequence: Synthetic oligonucleotide
cuuucaguucaggauggguc

SEQ ID NO: 3046 - RNA, 20 nt, Artificial Sequence
  Description of Artificial Sequence: Synthetic oligonucleotide
aaagcaucuaccuccauugc

SEQ ID NO: 3047 - RNA, 20 nt, Artificial Sequence
  Description of Artificial Sequence: Synthetic oligonucleotide
uuuccacagguguagacaca

SEQ ID NO: 3048 - RNA, 20 nt, Artificial Sequence
  Description of Artificial Sequence: Synthetic oligonucleotide
uuuuccacagguguagacac

SEQ ID NO: 3049 - RNA, 20 nt, Artificial Sequence
  Description of Artificial Sequence: Synthetic oligonucleotide
auuuuccacagguguagaca

SEQ ID NO: 3050 - RNA, 20 nt, Artificial Sequence
  Description of Artificial Sequence: Synthetic oligonucleotide
aggauuuuccacagguguag

SEQ ID NO: 3051 - RNA, 20 nt, Artificial Sequence
  Description of Artificial Sequence: Synthetic oligonucleotide
gcaggauuuuccacaggugu

SEQ ID NO: 3052 - RNA, 20 nt, Artificial Sequence
  Description of Artificial Sequence: Synthetic oligonucleotide
agcaggauuuuccacaggug

SEQ ID NO: 3053 - RNA, 20 nt, Artificial Sequence
  Description of Artificial Sequence: Synthetic oligonucleotide
gagcaggauuuuccacaggu

SEQ ID NO: 3054 - RNA, 20 nt, Artificial Sequence
  Description of Artificial Sequence: Synthetic oligonucleotide
ugagcaggauuuuccacagg

SEQ ID NO: 3055 - RNA, 20 nt, Artificial Sequence
  Description of Artificial Sequence: Synthetic oligonucleotide
cugagcaggauuuuccacag

SEQ ID NO: 3056 - RNA, 20 nt, Artificial Sequence
  Description of Artificial Sequence: Synthetic oligonucleotide
cggaucugagcaggauuuuc

SEQ ID NO: 3057 - RNA, 20 nt, Artificial Sequence
  Description of Artificial Sequence: Synthetic oligonucleotide
cucccggaucugagcaggau

SEQ ID NO: 3058 - RNA, 20 nt, Artificial Sequence
  Description of Artificial Sequence: Synthetic oligonucleotide
acaucucccggaucugagca

SEQ ID NO: 3059 - RNA, 20 nt, Artificial Sequence
  Description of Artificial Sequence: Synthetic oligonucleotide
aaacaucucccggaucugag

SEQ ID NO: 3060 - RNA, 20 nt, Artificial Sequence
  Description of Artificial Sequence: Synthetic oligonucleotide
caaacaucucccggaucuga

SEQ ID NO: 3061 - RNA, 20 nt, Artificial Sequence
  Description of Artificial Sequence: Synthetic oligonucleotide
ucaaacaucucccggaucug

SEQ ID NO: 3062 - RNA, 20 nt, Artificial Sequence
  Description of Artificial Sequence: Synthetic oligonucleotide
aucaaacaucucccggaucu

SEQ ID NO: 3063 - RNA, 20 nt, Artificial Sequence
  Description of Artificial Sequence: Synthetic oligonucleotide
caucaaacaucucccggauc

SEQ ID NO: 3064 - RNA, 20 nt, Artificial Sequence
  Description of Artificial Sequence: Synthetic oligonucleotide
ucaucaaacaucucccggau

SEQ ID NO: 3065 - RNA, 20 nt, Artificial Sequence
  Description of Artificial Sequence: Synthetic oligonucleotide
caucaucaaacaucucccgg

SEQ ID NO: 3066 - RNA, 20 nt, Artificial Sequence
  Description of Artificial Sequence: Synthetic oligonucleotide
acaucaucaaacaucucccg

SEQ ID NO: 3067 - RNA, 20 nt, Artificial Sequence
  Description of Artificial Sequence: Synthetic oligonucleotide
aacaucaucaaacaucuccc

SEQ ID NO: 3068 - RNA, 20 nt, Artificial Sequence
  Description of Artificial Sequence: Synthetic oligonucleotide
gaauacaagcucccuuauca

SEQ ID NO: 3069 - RNA, 20 nt, Artificial Sequence
  Description of Artificial Sequence: Synthetic oligonucleotide
agaauacaagcucccuuauc

SEQ ID NO: 3070 - RNA, 20 nt, Artificial Sequence
  Description of Artificial Sequence: Synthetic oligonucleotide
cagaauacaagcucccuuau

SEQ ID NO: 3071 - RNA, 20 nt, Artificial Sequence
  Description of Artificial Sequence: Synthetic oligonucleotide
ucagaauacaagcucccuua

SEQ ID NO: 3072 - RNA, 20 nt, Artificial Sequence
  Description of Artificial Sequence: Synthetic oligonucleotide
uucagaauacaagcucccuu

SEQ ID NO: 3073 - RNA, 20 nt, Artificial Sequence
  Description of Artificial Sequence: Synthetic oligonucleotide
auucagaauacaagcucccu

SEQ ID NO: 3074 - RNA, 20 nt, Artificial Sequence
  Description of Artificial Sequence: Synthetic oligonucleotide
cucccuuagcauauucagaa

SEQ ID NO: 3075 - RNA, 20 nt, Artificial Sequence
  Description of Artificial Sequence: Synthetic oligonucleotide
acucccuuagcauauucaga

SEQ ID NO: 3076 - RNA, 20 nt, Artificial Sequence
  Description of Artificial Sequence: Synthetic oligonucleotide
ugcuucuggagauacuguac

SEQ ID NO: 3077 - RNA, 20 nt, Artificial Sequence
  Description of Artificial Sequence: Synthetic oligonucleotide
augcuucuggagauacugua

SEQ ID NO: 3078 - RNA, 20 nt, Artificial Sequence
  Description of Artificial Sequence: Synthetic oligonucleotide
uaugcuucuggagauacugu

SEQ ID NO: 3079 - RNA, 20 nt, Artificial Sequence
  Description of Artificial Sequence: Synthetic oligonucleotide
aucccacagguccucguuuu

SEQ ID NO: 3080 - RNA, 20 nt, Artificial Sequence
  Description of Artificial Sequence: Synthetic oligonucleotide
uaucccacagguccucguuu

SEQ ID NO: 3081 - RNA, 20 nt, Artificial Sequence
  Description of Artificial Sequence: Synthetic oligonucleotide
cuaucccacagguccucguu

SEQ ID NO: 3082 - RNA, 20 nt, Artificial Sequence
  Description of Artificial Sequence: Synthetic oligonucleotide
uacuaucccacagguccucg

SEQ ID NO: 3083 - RNA, 20 nt, Artificial Sequence
  Description of Artificial Sequence: Synthetic oligonucleotide
auacuaucccacagguccuc

SEQ ID NO: 3084 - RNA, 20 nt, Artificial Sequence
  Description of Artificial Sequence: Synthetic oligonucleotide
ccauacuaucccacaggucc

SEQ ID NO: 3085 - RNA, 20 nt, Artificial Sequence
  Description of Artificial Sequence: Synthetic oligonucleotide
gccauacuaucccacagguc

SEQ ID NO: 3086 - RNA, 20 nt, Artificial Sequence
  Description of Artificial Sequence: Synthetic oligonucleotide
ugccauacuaucccacaggu

SEQ ID NO: 3087 - RNA, 20 nt, Artificial Sequence
  Description of Artificial Sequence: Synthetic oligonucleotide
uugccauacuaucccacagg

SEQ ID NO: 3088 - RNA, 20 nt, Artificial Sequence
  Description of Artificial Sequence: Synthetic oligonucleotide
cuugccauacuaucccacag

SEQ ID NO: 3089 - RNA, 20 nt, Artificial Sequence
  Description of Artificial Sequence: Synthetic oligonucleotide
acuugccauacuaucccaca

SEQ ID NO: 3090 - RNA, 20 nt, Artificial Sequence
  Description of Artificial Sequence: Synthetic oligonucleotide
uacuugccauacuaucccac

SEQ ID NO: 3091 - RNA, 20 nt, Artificial Sequence
  Description of Artificial Sequence: Synthetic oligonucleotide
auacuugccauacuauccca

SEQ ID NO: 3092 - RNA, 20 nt, Artificial Sequence
  Description of Artificial Sequence: Synthetic oligonucleotide
aauacuugccauacuauccc

SEQ ID NO: 3093 - RNA, 20 nt, Artificial Sequence
  Description of Artificial Sequence: Synthetic oligonucleotide
aucuguagggcaaauacuug

SEQ ID NO: 3094 - RNA, 20 nt, Artificial Sequence
  Description of Artificial Sequence: Synthetic oligonucleotide
caucuguagggcaaauacuu

SEQ ID NO: 3095 - RNA, 20 nt, Artificial Sequence
  Description of Artificial Sequence: Synthetic oligonucleotide
ccaucuguagggcaaauacu

SEQ ID NO: 3096 - RNA, 20 nt, Artificial Sequence
  Description of Artificial Sequence: Synthetic oligonucleotide
accaucuguagggcaaauac

SEQ ID NO: 3097 - RNA, 20 nt, Artificial Sequence
  Description of Artificial Sequence: Synthetic oligonucleotide
caccaucuguagggcaaaua

SEQ ID NO: 3098 - RNA, 20 nt, Artificial Sequence
  Description of Artificial Sequence: Synthetic oligonucleotide
acaccaucuguagggcaaau

SEQ ID NO: 3099 - RNA, 20 nt, Artificial Sequence
  Description of Artificial Sequence: Synthetic oligonucleotide
aucccuuuuacaccaucugu

SEQ ID NO: 3100 - RNA, 20 nt, Artificial Sequence
  Description of Artificial Sequence: Synthetic oligonucleotide
auccaucccuuuuacaccau

SEQ ID NO: 3101 - RNA, 20 nt, Artificial Sequence
  Description of Artificial Sequence: Synthetic oligonucleotide
cauccaucccuuuuacacca

SEQ ID NO: 3102 - RNA, 20 nt, Artificial Sequence
  Description of Artificial Sequence: Synthetic oligonucleotide
ccauccaucccuuuuacacc

SEQ ID NO: 3103 - RNA, 20 nt, Artificial Sequence
  Description of Artificial Sequence: Synthetic oligonucleotide
uagagcaaaagccauccauc

SEQ ID NO: 3104 - RNA, 20 nt, Artificial Sequence
  Description of Artificial Sequence: Synthetic oligonucleotide
cuagagcaaaagccauccau

SEQ ID NO: 3105 - RNA, 20 nt, Artificial Sequence
  Description of Artificial Sequence: Synthetic oligonucleotide
caaugugaggaugaagauga

SEQ ID NO: 3106 - RNA, 20 nt, Artificial Sequence
  Description of Artificial Sequence: Synthetic oligonucleotide
ccaaugugaggaugaagaug

SEQ ID NO: 3107 - RNA, 20 nt, Artificial Sequence
  Description of Artificial Sequence: Synthetic oligonucleotide
gccaaugugaggaugaagau

SEQ ID NO: 3108 - RNA, 20 nt, Artificial Sequence
  Description of Artificial Sequence: Synthetic oligonucleotide
ugccaaugugaggaugaaga

SEQ ID NO: 3109 - RNA, 20 nt, Artificial Sequence
  Description of Artificial Sequence: Synthetic oligonucleotide
augccaaugugaggaugaag

SEQ ID NO: 3110 - RNA, 20 nt, Artificial Sequence
  Description of Artificial Sequence: Synthetic oligonucleotide
gaugccaaugugaggaugaa

SEQ ID NO: 3111 - RNA, 20 nt, Artificial Sequence
  Description of Artificial Sequence: Synthetic oligonucleotide
cugaugccaaugugaggaug

SEQ ID NO: 3112 - RNA, 20 nt, Artificial Sequence
  Description of Artificial Sequence: Synthetic oligonucleotide
ccugaugccaaugugaggau

SEQ ID NO: 3113 - RNA, 20 nt, Artificial Sequence
  Description of Artificial Sequence: Synthetic oligonucleotide
ucaugguuuucacauccacc

SEQ ID NO: 3114 - RNA, 20 nt, Artificial Sequence
  Description of Artificial Sequence: Synthetic oligonucleotide
aucaugguuuucacauccac

SEQ ID NO: 3115 - RNA, 20 nt, Artificial Sequence
  Description of Artificial Sequence: Synthetic oligonucleotide
caucaugguuuucacaucca

SEQ ID NO: 3116 - RNA, 20 nt, Artificial Sequence
  Description of Artificial Sequence: Synthetic oligonucleotide
ucaucaugguuuucacaucc

SEQ ID NO: 3117 - RNA, 20 nt, Artificial Sequence
  Description of Artificial Sequence: Synthetic oligonucleotide
ccaaguguucaucaugguuu

SEQ ID NO: 3118 - RNA, 20 nt, Artificial Sequence
  Description of Artificial Sequence: Synthetic oligonucleotide
uccaaguguucaucaugguu

SEQ ID NO: 3119 - RNA, 20 nt, Artificial Sequence
  Description of Artificial Sequence: Synthetic oligonucleotide
cacugugaugguuauuaggg

SEQ ID NO: 3120 - RNA, 20 nt, Artificial Sequence
  Description of Artificial Sequence: Synthetic oligonucleotide
cucacugugaugguuauuag

SEQ ID NO: 3121 - RNA, 20 nt, Artificial Sequence
  Description of Artificial Sequence: Synthetic oligonucleotide
gugcucuugcuucaugugua

SEQ ID NO: 3122 - RNA, 20 nt, Artificial Sequence
  Description of Artificial Sequence: Synthetic oligonucleotide
agugcucuugcuucaugugu

SEQ ID NO: 3123 - RNA, 20 nt, Artificial Sequence
  Description of Artificial Sequence: Synthetic oligonucleotide
uagugcucuugcuucaugug

SEQ ID NO: 3124 - RNA, 20 nt, Artificial Sequence
  Description of Artificial Sequence: Synthetic oligonucleotide
guagugcucuugcuucaugu

SEQ ID NO: 3125 - RNA, 20 nt, Artificial Sequence
  Description of Artificial Sequence: Synthetic oligonucleotide
uguagugcucuugcuucaug

SEQ ID NO: 3126 - RNA, 20 nt, Artificial Sequence
  Description of Artificial Sequence: Synthetic oligonucleotide
auguagugcucuugcuucau

SEQ ID NO: 3127 - RNA, 20 nt, Artificial Sequence
  Description of Artificial Sequence: Synthetic oligonucleotide
cauguagugcucuugcuuca

SEQ ID NO: 3128 - RNA, 20 nt, Artificial Sequence
  Description of Artificial Sequence: Synthetic oligonucleotide
ccuucauguagugcucuugc

SEQ ID NO: 3129 - RNA, 20 nt, Artificial Sequence
  Description of Artificial Sequence: Synthetic oligonucleotide
cccuucauguagugcucuug

SEQ ID NO: 3130 - RNA, 20 nt, Artificial Sequence
  Description of Artificial Sequence: Synthetic oligonucleotide
gcccuucauguagugcucuu

SEQ ID NO: 3131 - RNA, 20 nt, Artificial Sequence
  Description of Artificial Sequence: Synthetic oligonucleotide
agcccuucauguagugcucu

SEQ ID NO: 3132 - RNA, 20 nt, Artificial Sequence
  Description of Artificial Sequence: Synthetic oligonucleotide
agagcccuucauguagugcu

SEQ ID NO: 3133 - RNA, 20 nt, Artificial Sequence
  Description of Artificial Sequence: Synthetic oligonucleotide
cagagcccuucauguagugc

SEQ ID NO: 3134 - RNA, 20 nt, Artificial Sequence
  Description of Artificial Sequence: Synthetic oligonucleotide
ucagagcccuucauguagug

SEQ ID NO: 3135 - RNA, 20 nt, Artificial Sequence
  Description of Artificial Sequence: Synthetic oligonucleotide
cgucagagcccuucauguag

SEQ ID NO: 3136 - RNA, 20 nt, Artificial Sequence
  Description of Artificial Sequence: Synthetic oligonucleotide
ccgucagagcccuucaugua

SEQ ID NO: 3137 - RNA, 20 nt, Artificial Sequence
  Description of Artificial Sequence: Synthetic oligonucleotide
auggaacaugccacagguac

SEQ ID NO: 3138 - RNA, 20 nt, Artificial Sequence
  Description of Artificial Sequence: Synthetic oligonucleotide
aauggaacaugccacaggua

SEQ ID NO: 3139 - RNA, 20 nt, Artificial Sequence
  Description of Artificial Sequence: Synthetic oligonucleotide
caauggaacaugccacaggu

SEQ ID NO: 3140 - RNA, 20 nt, Artificial Sequence
  Description of Artificial Sequence: Synthetic oligonucleotide
ucaauggaacaugccacagg

SEQ ID NO: 3141 - RNA, 20 nt, Artificial Sequence
  Description of Artificial Sequence: Synthetic oligonucleotide
gucaauggaacaugccacag

SEQ ID NO: 3142 - RNA, 20 nt, Artificial Sequence
  Description of Artificial Sequence: Synthetic oligonucleotide
ugucaauggaacaugccaca

SEQ ID NO: 3143 - RNA, 20 nt, Artificial Sequence
  Description of Artificial Sequence: Synthetic oligonucleotide
uugcuggugaugaaugucaa

SEQ ID NO: 3144 - RNA, 20 nt, Artificial Sequence
  Description of Artificial Sequence: Synthetic oligonucleotide
ccauuccaccucuucuggga

SEQ ID NO: 3145 - RNA, 20 nt, Artificial Sequence
  Description of Artificial Sequence: Synthetic oligonucleotide
aauuugauccauuccaccuc

SEQ ID NO: 3146 - RNA, 20 nt, Artificial Sequence
  Description of Artificial Sequence: Synthetic oligonucleotide
ccauucaugcccacauuaaa

SEQ ID NO: 3147 - RNA, 20 nt, Artificial Sequence
  Description of Artificial Sequence: Synthetic oligonucleotide
gccauucaugcccacauuaa

SEQ ID NO: 3148 - RNA, 20 nt, Artificial Sequence
  Description of Artificial Sequence: Synthetic oligonucleotide
agccauucaugcccacauua

SEQ ID NO: 3149 - RNA, 20 nt, Artificial Sequence
  Description of Artificial Sequence: Synthetic oligonucleotide
uagccauucaugcccacauu

SEQ ID NO: 3150 - RNA, 20 nt, Artificial Sequence
  Description of Artificial Sequence: Synthetic oligonucleotide
auagccauucaugcccacau

SEQ ID NO: 3151 - RNA, 20 nt, Artificial Sequence
  Description of Artificial Sequence: Synthetic oligonucleotide
guaauagccauucaugccca

SEQ ID NO: 3152 - RNA, 20 nt, Artificial Sequence
  Description of Artificial Sequence: Synthetic oligonucleotide
uccucguaaugcacaaugua

SEQ ID NO: 3153 - RNA, 20 nt, Artificial Sequence
  Description of Artificial Sequence: Synthetic oligonucleotide
auccucguaaugcacaaugu

SEQ ID NO: 3154 - RNA, 20 nt, Artificial Sequence
  Description of Artificial Sequence: Synthetic oligonucleotide
cauccucguaaugcacaaug

SEQ ID NO: 3155 - RNA, 20 nt, Artificial Sequence
  Description of Artificial Sequence: Synthetic oligonucleotide
ucauccucguaaugcacaau

SEQ ID NO: 3156 - RNA, 20 nt, Artificial Sequence
  Description of Artificial Sequence: Synthetic oligonucleotide
aucauccucguaaugcacaa

SEQ ID NO: 3157 - RNA, 20 nt, Artificial Sequence
  Description of Artificial Sequence: Synthetic oligonucleotide
caucauccucguaaugcaca

SEQ ID NO: 3158 - RNA, 20 nt, Artificial Sequence
  Description of Artificial Sequence: Synthetic oligonucleotide
ccaucauccucguaaugcac

SEQ ID NO: 3159 - RNA, 20 nt, Artificial Sequence
  Description of Artificial Sequence: Synthetic oligonucleotide
uccaucauccucguaaugca

SEQ ID NO: 3160 - RNA, 20 nt, Artificial Sequence
  Description of Artificial Sequence: Synthetic oligonucleotide
auccaucauccucguaaugc

SEQ ID NO: 3161 - RNA, 20 nt, Artificial Sequence
  Description of Artificial Sequence: Synthetic oligonucleotide
cauccaucauccucguaaug

SEQ ID NO: 3162 - RNA, 20 nt, Artificial Sequence
  Description of Artificial Sequence: Synthetic oligonucleotide
ccauccaucauccucguaau

SEQ ID NO: 3163 - RNA, 20 nt, Artificial Sequence
  Description of Artificial Sequence: Synthetic oligonucleotide
cccauccaucauccucguaa

SEQ ID NO: 3164 - RNA, 20 nt, Artificial Sequence
  Description of Artificial Sequence: Synthetic oligonucleotide
gucccauccaucauccucgu

SEQ ID NO: 3165 - RNA, 20 nt, Artificial Sequence
  Description of Artificial Sequence: Synthetic oligonucleotide
agucccauccaucauccucg

SEQ ID NO: 3166 - RNA, 20 nt, Artificial Sequence
  Description of Artificial Sequence: Synthetic oligonucleotide
gagucccauccaucauccuc

SEQ ID NO: 3167 - RNA, 20 nt, Artificial Sequence
  Description of Artificial Sequence: Synthetic oligonucleotide
caaagagucccauccaucau

SEQ ID NO: 3168 - RNA, 20 nt, Artificial Sequence
  Description of Artificial Sequence: Synthetic oligonucleotide
ucaaagagucccauccauca

SEQ ID NO: 3169 - RNA, 20 nt, Artificial Sequence
  Description of Artificial Sequence: Synthetic oligonucleotide
agucaaagagucccauccau

SEQ ID NO: 3170 - RNA, 20 nt, Artificial Sequence
  Description of Artificial Sequence: Synthetic oligonucleotide
cagucaaagagucccaucca

SEQ ID NO: 3171 - RNA, 20 nt, Artificial Sequence
  Description of Artificial Sequence: Synthetic oligonucleotide
ccagucaaagagucccaucc

SEQ ID NO: 3172 - RNA, 20 nt, Artificial Sequence
  Description of Artificial Sequence: Synthetic oligonucleotide
gccagucaaagagucccauc

SEQ ID NO: 3173 - RNA, 20 nt, Artificial Sequence
  Description of Artificial Sequence: Synthetic oligonucleotide
ggccagucaaagagucccau

SEQ ID NO: 3174 - RNA, 20 nt, Artificial Sequence
  Description of Artificial Sequence: Synthetic oligonucleotide
aggccagucaaagaguccca

SEQ ID NO: 3175 - RNA, 20 nt, Artificial Sequence
  Description of Artificial Sequence: Synthetic oligonucleotide
aaggccagucaaagaguccc

SEQ ID NO: 3176 - RNA, 20 nt, Artificial Sequence
  Description of Artificial Sequence: Synthetic oligonucleotide
aaaggccagucaaagagucc

SEQ ID NO: 3177 - RNA, 20 nt, Artificial Sequence
  Description of Artificial Sequence: Synthetic oligonucleotide
uaaaaggccagucaaagagu

SEQ ID NO: 3178 - RNA, 20 nt, Artificial Sequence
  Description of Artificial Sequence: Synthetic oligonucleotide
uuaaaaggccagucaaagag

SEQ ID NO: 3179 - RNA, 20 nt, Artificial Sequence
  Description of Artificial Sequence: Synthetic oligonucleotide
uuacugcugacugcugugug

SEQ ID NO: 3180 - RNA, 20 nt, Artificial Sequence
  Description of Artificial Sequence: Synthetic oligonucleotide
cauuacugcugacugcugug

SEQ ID NO: 3181 - RNA, 20 nt, Artificial Sequence
  Description of Artificial Sequence: Synthetic oligonucleotide
ucauuacugcugacugcugu

SEQ ID NO: 3182 - RNA, 20 nt, Artificial Sequence
  Description of Artificial Sequence: Synthetic oligonucleotide
aucauuacugcugacugcug

SEQ ID NO: 3183 - RNA, 20 nt, Artificial Sequence
  Description of Artificial Sequence: Synthetic oligonucleotide
gaucauuacugcugacugcu

SEQ ID NO: 3184 - RNA, 20 nt, Artificial Sequence
  Description of Artificial Sequence: Synthetic oligonucleotide
cgaucauuacugcugacugc

SEQ ID NO: 3185 - RNA, 20 nt, Artificial Sequence
  Description of Artificial Sequence: Synthetic oligonucleotide
ccgaucauuacugcugacug

SEQ ID NO: 3186 - RNA, 20 nt, Artificial Sequence
  Description of Artificial Sequence: Synthetic oligonucleotide
ucaauggacagcuucccaau

SEQ ID NO: 3187 - RNA, 20 nt, Artificial Sequence
  Description of Artificial Sequence: Synthetic oligonucleotide
uucaauggacagcuucccaa

SEQ ID NO: 3188 - RNA, 20 nt, Artificial Sequence
  Description of Artificial Sequence: Synthetic oligonucleotide
uuuucaauggacagcuuccc

SEQ ID NO: 3189 - RNA, 20 nt, Artificial Sequence
  Description of Artificial Sequence: Synthetic oligonucleotide
cuuuucaauggacagcuucc

SEQ ID NO: 3190 - RNA, 20 nt, Artificial Sequence
  Description of Artificial Sequence: Synthetic oligonucleotide
uacagggauaaauccaaggc

SEQ ID NO: 3191 - RNA, 20 nt, Artificial Sequence
  Description of Artificial Sequence: Synthetic oligonucleotide
guacagggauaaauccaagg

SEQ ID NO: 3192 - RNA, 20 nt, Artificial Sequence
  Description of Artificial Sequence: Synthetic oligonucleotide
aguacagggauaaauccaag

SEQ ID NO: 3193 - RNA, 20 nt, Artificial Sequence
  Description of Artificial Sequence: Synthetic oligonucleotide
caaguacagggauaaaucca

SEQ ID NO: 3194 - RNA, 20 nt, Artificial Sequence
  Description of Artificial Sequence: Synthetic oligonucleotide
ucaaguacagggauaaaucc

SEQ ID NO: 3195 - RNA, 20 nt, Artificial Sequence
  Description of Artificial Sequence: Synthetic oligonucleotide
cgggcauaauuucaguuuca

SEQ ID NO: 3196 - RNA, 20 nt, Artificial Sequence
  Description of Artificial Sequence: Synthetic oligonucleotide
acgggcauaauuucaguuuc

SEQ ID NO: 3197 - RNA, 20 nt, Artificial Sequence
  Description of Artificial Sequence: Synthetic oligonucleotide
cacgggcauaauuucaguuu

SEQ ID NO: 3198 - RNA, 20 nt, Artificial Sequence
  Description of Artificial Sequence: Synthetic oligonucleotide
acacgggcauaauuucaguu

SEQ ID NO: 3199 - RNA, 20 nt, Artificial Sequence
  Description of Artificial Sequence: Synthetic oligonucleotide
aacacgggcauaauuucagu

SEQ ID NO: 3200 - RNA, 20 nt, Artificial Sequence
  Description of Artificial Sequence: Synthetic oligonucleotide
aaacacgggcauaauuucag

SEQ ID NO: 3201 - RNA, 20 nt, Artificial Sequence
  Description of Artificial Sequence: Synthetic oligonucleotide
cuugaaacacgggcauaauu

SEQ ID NO: 3202 - RNA, 20 nt, Artificial Sequence
  Description of Artificial Sequence: Synthetic oligonucleotide
ccuugaaacacgggcauaau

SEQ ID NO: 3203 - RNA, 20 nt, Artificial Sequence
  Description of Artificial Sequence: Synthetic oligonucleotide
accuugaaacacgggcauaa

SEQ ID NO: 3204 - RNA, 20 nt, Artificial Sequence
  Description of Artificial Sequence: Synthetic oligonucleotide
aaccuugaaacacgggcaua

SEQ ID NO: 3205 - RNA, 20 nt, Artificial Sequence
  Description of Artificial Sequence: Synthetic oligonucleotide
aaaccuugaaacacgggcau

SEQ ID NO: 3206 - RNA, 20 nt, Artificial Sequence
  Description of Artificial Sequence: Synthetic oligonucleotide
caaaccuugaaacacgggca

SEQ ID NO: 3207 - RNA, 20 nt, Artificial Sequence
  Description of Artificial Sequence: Synthetic oligonucleotide
ccuugaauugaguuuccacu

SEQ ID NO: 3208 - RNA, 20 nt, Artificial Sequence
  Description of Artificial Sequence: Synthetic oligonucleotide
gccuugaauugaguuuccac

SEQ ID NO: 3209 - RNA, 20 nt, Artificial Sequence
  Description of Artificial Sequence: Synthetic oligonucleotide
ggccuugaauugaguuucca

SEQ ID NO: 3210 - RNA, 20 nt, Artificial Sequence
  Description of Artificial Sequence: Synthetic oligonucleotide
uuagcagccugaugaggaag

SEQ ID NO: 3211 - RNA, 20 nt, Artificial Sequence
  Description of Artificial Sequence: Synthetic oligonucleotide
gaggucccuuagcagccuga

SEQ ID NO: 3212 - RNA, 20 nt, Artificial Sequence
  Description of Artificial Sequence: Synthetic oligonucleotide
augaggucccuuagcagccu

SEQ ID NO: 3213 - RNA, 20 nt, Artificial Sequence
  Description of Artificial Sequence: Synthetic oligonucleotide
ucaaugaggucccuuagcag

SEQ ID NO: 3214 - RNA, 20 nt, Artificial Sequence
  Description of Artificial Sequence: Synthetic oligonucleotide
aucaaugaggucccuuagca

SEQ ID NO: 3215 - RNA, 20 nt, Artificial Sequence
  Description of Artificial Sequence: Synthetic oligonucleotide
uaucaaugaggucccuuagc

SEQ ID NO: 3216 - RNA, 20 nt, Artificial Sequence
  Description of Artificial Sequence: Synthetic oligonucleotide
uuaucaaugaggucccuuag

SEQ ID NO: 3217 - RNA, 20 nt, Artificial Sequence
  Description of Artificial Sequence: Synthetic oligonucleotide
ugcuuaucaaugaggucccu

SEQ ID NO: 3218 - RNA, 20 nt, Artificial Sequence
  Description of Artificial Sequence: Synthetic oligonucleotide
cugcuuaucaaugagguccc

SEQ ID NO: 3219 - RNA, 20 nt, Artificial Sequence
  Description of Artificial Sequence: Synthetic oligonucleotide
ucugcuuaucaaugaggucc

SEQ ID NO: 3220 - RNA, 20 nt, Artificial Sequence
  Description of Artificial Sequence: Synthetic oligonucleotide
gucugcuuaucaaugagguc

SEQ ID NO: 3221 - RNA, 20 nt, Artificial Sequence
  Description of Artificial Sequence: Synthetic oligonucleotide
ugucugcuuaucaaugaggu

SEQ ID NO: 3222 - RNA, 20 nt, Artificial Sequence
  Description of Artificial Sequence: Synthetic oligonucleotide
caugucugcuuaucaaugag

SEQ ID NO: 3223 - RNA, 20 nt, Artificial Sequence
  Description of Artificial Sequence: Synthetic oligonucleotide
cuguccaugucugcuuauca

SEQ ID NO: 3224 - RNA, 20 nt, Artificial Sequence
  Description of Artificial Sequence: Synthetic oligonucleotide
ucuguccaugucugcuuauc

SEQ ID NO: 3225 - RNA, 20 nt, Artificial Sequence
  Description of Artificial Sequence: Synthetic oligonucleotide
ucgucuguccaugucugcuu

SEQ ID NO: 3226 - RNA, 20 nt, Artificial Sequence
  Description of Artificial Sequence: Synthetic oligonucleotide
cucgucuguccaugucugcu

SEQ ID NO: 3227 - RNA, 20 nt, Artificial Sequence
  Description of Artificial Sequence: Synthetic oligonucleotide
gcccucgucuguccaugucu

SEQ ID NO: 3228 - RNA, 20 nt, Artificial Sequence
  Description of Artificial Sequence: Synthetic oligonucleotide
agcccucgucuguccauguc

SEQ ID NO: 3229 - RNA, 20 nt, Artificial Sequence
  Description of Artificial Sequence: Synthetic oligonucleotide
gagcccucgucuguccaugu

SEQ ID NO: 3230 - RNA, 20 nt, Artificial Sequence
  Description of Artificial Sequence: Synthetic oligonucleotide
cugagcccucgucuguccau

SEQ ID NO: 3231 - RNA, 20 nt, Artificial Sequence
  Description of Artificial Sequence: Synthetic oligonucleotide
acugagcccucgucugucca

SEQ ID NO: 3232 - RNA, 20 nt, Artificial Sequence
  Description of Artificial Sequence: Synthetic oligonucleotide
acaggcgaggaguaguaguu

SEQ ID NO: 3233 - RNA, 20 nt, Artificial Sequence
  Description of Artificial Sequence: Synthetic oligonucleotide
cacaggcgaggaguaguagu

SEQ ID NO: 3234 - RNA, 20 nt, Artificial Sequence
  Description of Artificial Sequence: Synthetic oligonucleotide
acacaggcgaggaguaguag

SEQ ID NO: 3235 - RNA, 20 nt, Artificial Sequence
  Description of Artificial Sequence: Synthetic oligonucleotide
cacacaggcgaggaguagua

SEQ ID NO: 3236 - RNA, 20 nt, Artificial Sequence
  Description of Artificial Sequence: Synthetic oligonucleotide
gcacacaggcgaggaguagu

SEQ ID NO: 3237 - RNA, 20 nt, Artificial Sequence
  Description of Artificial Sequence: Synthetic oligonucleotide
ugcacacaggcgaggaguag

SEQ ID NO: 3238 - RNA, 20 nt, Artificial Sequence
  Description of Artificial Sequence: Synthetic oligonucleotide
uagccuucugcccucuguac

SEQ ID NO: 3239 - RNA, 20 nt, Artificial Sequence
  Description of Artificial Sequence: Synthetic oligonucleotide
aaauagccuucugcccucug

SEQ ID NO: 3240 - RNA, 20 nt, Artificial Sequence
  Description of Artificial Sequence: Synthetic oligonucleotide
gaaauagccuucugcccucu

SEQ ID NO: 3241 - RNA, 20 nt, Artificial Sequence
  Description of Artificial Sequence: Synthetic oligonucleotide
cugaaauagccuucugcccu

SEQ ID NO: 3242 - RNA, 20 nt, Artificial Sequence
  Description of Artificial Sequence: Synthetic oligonucleotide
uuucugaaauagccuucugc

SEQ ID NO: 3243 - RNA, 20 nt, Artificial Sequence
  Description of Artificial Sequence: Synthetic oligonucleotide
uuccacuuucugaaauagcc

SEQ ID NO: 3244 - RNA, 20 nt, Artificial Sequence
  Description of Artificial Sequence: Synthetic oligonucleotide
gcucaaguuuccauuggauu

SEQ ID NO: 3245 - RNA, 20 nt, Artificial Sequence
  Description of Artificial Sequence: Synthetic oligonucleotide
ggcucaaguuuccauuggau

SEQ ID NO: 3246 - RNA, 20 nt, Artificial Sequence
  Description of Artificial Sequence: Synthetic oligonucleotide
aggcucaaguuuccauugga

SEQ ID NO: 3247 - RNA, 20 nt, Artificial Sequence
  Description of Artificial Sequence: Synthetic oligonucleotide
cacugccaaggucacgucga

SEQ ID NO: 3248 - RNA, 20 nt, Artificial Sequence
  Description of Artificial Sequence: Synthetic oligonucleotide
acacugccaaggucacgucg

SEQ ID NO: 3249 - RNA, 20 nt, Artificial Sequence
  Description of Artificial Sequence: Synthetic oligonucleotide
aacacugccaaggucacguc

SEQ ID NO: 3250 - RNA, 20 nt, Artificial Sequence
  Description of Artificial Sequence: Synthetic oligonucleotide
aaacacugccaaggucacgu

SEQ ID NO: 3251 - RNA, 20 nt, Artificial Sequence
  Description of Artificial Sequence: Synthetic oligonucleotide
cagcaaacacugccaagguc

SEQ ID NO: 3252 - RNA, 20 nt, Artificial Sequence
  Description of Artificial Sequence: Synthetic oligonucleotide
ccacagcaaacacugccaag

SEQ ID NO: 3253 - RNA, 20 nt, Artificial Sequence
  Description of Artificial Sequence: Synthetic oligonucleotide
uaaagaaaaucccagccuuc

SEQ ID NO: 3254 - RNA, 20 nt, Artificial Sequence
  Description of Artificial Sequence: Synthetic oligonucleotide
guacuggacaaagaaaacug

SEQ ID NO: 3255 - RNA, 20 nt, Artificial Sequence
  Description of Artificial Sequence: Synthetic oligonucleotide
ugcagagggcaaauucaauu

SEQ ID NO: 3256 - RNA, 20 nt, Artificial Sequence
  Description of Artificial Sequence: Synthetic oligonucleotide
aucuaguagccauugaagcu

SEQ ID NO: 3257 - RNA, 20 nt, Artificial Sequence
  Description of Artificial Sequence: Synthetic oligonucleotide
caucuaguagccauugaagc

SEQ ID NO: 3258 - RNA, 20 nt, Artificial Sequence
  Description of Artificial Sequence: Synthetic oligonucleotide
ucaucuaguagccauugaag

SEQ ID NO: 3259 - RNA, 20 nt, Artificial Sequence
  Description of Artificial Sequence: Synthetic oligonucleotide
cuuucaucuaguagccauug

SEQ ID NO: 3260 - RNA, 20 nt, Artificial Sequence
  Description of Artificial Sequence: Synthetic oligonucleotide
gcuuucaucuaguagccauu

SEQ ID NO: 3261 - RNA, 20 nt, Artificial Sequence
  Description of Artificial Sequence: Synthetic oligonucleotide
agcuuucaucuaguagccau

SEQ ID NO: 3262 - RNA, 20 nt, Artificial Sequence
  Description of Artificial Sequence: Synthetic oligonucleotide
cugccaaugaguguaagaau

SEQ ID NO: 3263 - RNA, 20 nt, Artificial Sequence
  Description of Artificial Sequence: Synthetic oligonucleotide
ccugccaaugaguguaagaa

SEQ ID NO: 3264 - RNA, 20 nt, Artificial Sequence
  Description of Artificial Sequence: Synthetic oligonucleotide
uccugccaaugaguguaaga

SEQ ID NO: 3265 - RNA, 20 nt, Artificial Sequence
  Description of Artificial Sequence: Synthetic oligonucleotide
uuccugccaaugaguguaag

SEQ ID NO: 3266 - RNA, 20 nt, Artificial Sequence
  Description of Artificial Sequence: Synthetic oligonucleotide
guuccugccaaugaguguaa

SEQ ID NO: 3267 - RNA, 20 nt, Artificial Sequence
  Description of Artificial Sequence: Synthetic oligonucleotide
gguuccugccaaugagugua

SEQ ID NO: 3268 - RNA, 20 nt, Artificial Sequence
  Description of Artificial Sequence: Synthetic oligonucleotide
ggguuccugccaaugagugu

SEQ ID NO: 3269 - RNA, 20 nt, Artificial Sequence
  Description of Artificial Sequence: Synthetic oligonucleotide
uggguuccugccaaugagug

SEQ ID NO: 3270 - RNA, 20 nt, Artificial Sequence
  Description of Artificial Sequence: Synthetic oligonucleotide
uacuggguuccugccaauga

SEQ ID NO: 3271 - RNA, 20 nt, Artificial Sequence
  Description of Artificial Sequence: Synthetic oligonucleotide
auccuacuggguuccugcca

SEQ ID NO: 3272 - RNA, 20 nt, Artificial Sequence
  Description of Artificial Sequence: Synthetic oligonucleotide
uauccuacuggguuccugcc

SEQ ID NO: 3273 - RNA, 20 nt, Artificial Sequence
  Description of Artificial Sequence: Synthetic oligonucleotide
guauccuacuggguuccugc

SEQ ID NO: 3274 - RNA, 20 nt, Artificial Sequence
  Description of Artificial Sequence: Synthetic oligonucleotide
gguauccuacuggguuccug

SEQ ID NO: 3275 - RNA, 20 nt, Artificial Sequence
  Description of Artificial Sequence: Synthetic oligonucleotide
ggguauccuacuggguuccu

SEQ ID NO: 3276 - RNA, 20 nt, Artificial Sequence
  Description of Artificial Sequence: Synthetic oligonucleotide
uggguauccuacuggguucc

SEQ ID NO: 3277 - RNA, 20 nt, Artificial Sequence
  Description of Artificial Sequence: Synthetic oligonucleotide
uccucagaaauugccaggcc

SEQ ID NO: 3278 - RNA, 20 nt, Artificial Sequence
  Description of Artificial Sequence: Synthetic oligonucleotide
uuccucagaaauugccaggc

SEQ ID NO: 3279 - RNA, 20 nt, Artificial Sequence
  Description of Artificial Sequence: Synthetic oligonucleotide
agaugagccaaguucaaacu

SEQ ID NO: 3280 - RNA, 20 nt, Artificial Sequence
  Description of Artificial Sequence: Synthetic oligonucleotide
aagaugagccaaguucaaac

SEQ ID NO: 3281 - RNA, 20 nt, Artificial Sequence
  Description of Artificial Sequence: Synthetic oligonucleotide
gaagaugagccaaguucaaa

SEQ ID NO: 3282 - RNA, 20 nt, Artificial Sequence
  Description of Artificial Sequence: Synthetic oligonucleotide
ggaagaugagccaaguucaa

SEQ ID NO: 3283 - RNA, 20 nt, Artificial Sequence
  Description of Artificial Sequence: Synthetic oligonucleotide
uggaagaugagccaaguuca

SEQ ID NO: 3284 - RNA, 20 nt, Artificial Sequence
  Description of Artificial Sequence: Synthetic oligonucleotide
auggaagaugagccaaguuc

SEQ ID NO: 3285 - RNA, 20 nt, Artificial Sequence
  Description of Artificial Sequence: Synthetic oligonucleotide
ugugggcuauggaagaugag

SEQ ID NO: 3286 - RNA, 20 nt, Artificial Sequence
  Description of Artificial Sequence: Synthetic oligonucleotide
ccauuaccaugugggcuaug

SEQ ID NO: 3287 - RNA, 20 nt, Artificial Sequence
  Description of Artificial Sequence: Synthetic oligonucleotide
guuguacccauuaccaugug

SEQ ID NO: 3288 - RNA, 20 nt, Artificial Sequence
  Description of Artificial Sequence: Synthetic oligonucleotide
uguuguacccauuaccaugu

SEQ ID NO: 3289 - RNA, 20 nt, Artificial Sequence
  Description of Artificial Sequence: Synthetic oligonucleotide
uuguuguacccauuaccaug

SEQ ID NO: 3290 - RNA, 20 nt, Artificial Sequence
  Description of Artificial Sequence: Synthetic oligonucleotide
aagccguguucuuguggaga

SEQ ID NO: 3291 - RNA, 20 nt, Artificial Sequence
  Description of Artificial Sequence: Synthetic oligonucleotide
ccucuucaagccguguucuu

SEQ ID NO: 3292 - RNA, 20 nt, Artificial Sequence
  Description of Artificial Sequence: Synthetic oligonucleotide
accucuucaagccguguucu

SEQ ID NO: 3293 - RNA, 20 nt, Artificial Sequence
  Description of Artificial Sequence: Synthetic oligonucleotide
uaccucuucaagccguguuc

SEQ ID NO: 3294 - RNA, 20 nt, Artificial Sequence
  Description of Artificial Sequence: Synthetic oligonucleotide
uuaccucuucaagccguguu

SEQ ID NO: 3295 - RNA, 20 nt, Artificial Sequence
  Description of Artificial Sequence: Synthetic oligonucleotide
uuuaccucuucaagccgugu

SEQ ID NO: 3296 - RNA, 20 nt, Artificial Sequence
  Description of Artificial Sequence: Synthetic oligonucleotide
uuuuaccucuucaagccgug

SEQ ID NO: 3297 - RNA, 20 nt, Artificial Sequence
  Description of Artificial Sequence: Synthetic oligonucleotide
cuuuuaccucuucaagccgu

SEQ ID NO: 3298 - RNA, 20 nt, Artificial Sequence
  Description of Artificial Sequence: Synthetic oligonucleotide
ccuuuuaccucuucaagccg

SEQ ID NO: 3299 - RNA, 20 nt, Artificial Sequence
  Description of Artificial Sequence: Synthetic oligonucleotide
auccuuuuaccucuucaagc

SEQ ID NO: 3300 - RNA, 20 nt, Artificial Sequence
  Description of Artificial Sequence: Synthetic oligonucleotide
cugaagaauccuuuuaccuc

SEQ ID NO: 3301 - RNA, 20 nt, Artificial Sequence
  Description of Artificial Sequence: Synthetic oligonucleotide
gcugaagaauccuuuuaccu

SEQ ID NO: 3302 - RNA, 20 nt, Artificial Sequence
  Description of Artificial Sequence: Synthetic oligonucleotide
agcugaagaauccuuuuacc

SEQ ID NO: 3303 - RNA, 20 nt, Artificial Sequence
  Description of Artificial Sequence: Synthetic oligonucleotide
acggagcugagaaccauuuu

SEQ ID NO: 3304 - RNA, 20 nt, Artificial Sequence
  Description of Artificial Sequence: Synthetic oligonucleotide
aacggagcugagaaccauuu

SEQ ID NO: 3305 - RNA, 20 nt, Artificial Sequence
  Description of Artificial Sequence: Synthetic oligonucleotide
caacggagcugagaaccauu

SEQ ID NO: 3306 - RNA, 20 nt, Artificial Sequence
  Description of Artificial Sequence: Synthetic oligonucleotide
acaacggagcugagaaccau

SEQ ID NO: 3307 - RNA, 20 nt, Artificial Sequence
  Description of Artificial Sequence: Synthetic oligonucleotide
cacaacggagcugagaacca

SEQ ID NO: 3308 - RNA, 20 nt, Artificial Sequence
  Description of Artificial Sequence: Synthetic oligonucleotide
acacaacggagcugagaacc

SEQ ID NO: 3309 - RNA, 20 nt, Artificial Sequence
  Description of Artificial Sequence: Synthetic oligonucleotide
gacacaacggagcugagaac

SEQ ID NO: 3310 - RNA, 20 nt, Artificial Sequence
  Description of Artificial Sequence: Synthetic oligonucleotide
ggacacaacggagcugagaa

SEQ ID NO: 3311 - RNA, 20 nt, Artificial Sequence
  Description of Artificial Sequence: Synthetic oligonucleotide
uggacacaacggagcugaga

SEQ ID NO: 3312 - RNA, 20 nt, Artificial Sequence
  Description of Artificial Sequence: Synthetic oligonucleotide
uuggacacaacggagcugag

SEQ ID NO: 3313 - RNA, 20 nt, Artificial Sequence
  Description of Artificial Sequence: Synthetic oligonucleotide
accgauguuuucuucaaugg

SEQ ID NO: 3314 - RNA, 20 nt, Artificial Sequence
  Description of Artificial Sequence: Synthetic oligonucleotide
ccaaccgauguuuucuucaa

SEQ ID NO: 3315 - RNA, 20 nt, Artificial Sequence
  Description of Artificial Sequence: Synthetic oligonucleotide
uccaaccgauguuuucuuca

SEQ ID NO: 3316 - RNA, 20 nt, Artificial Sequence
  Description of Artificial Sequence: Synthetic oligonucleotide
auccaaccgauguuuucuuc

SEQ ID NO: 3317 - RNA, 20 nt, Artificial Sequence
  Description of Artificial Sequence: Synthetic oligonucleotide
uucuuauccauccaaccgau

SEQ ID NO: 3318 - RNA, 20 nt, Artificial Sequence
  Description of Artificial Sequence: Synthetic oligonucleotide
auucuuauccauccaaccga

SEQ ID NO: 3319 - RNA, 20 nt, Artificial Sequence
  Description of Artificial Sequence: Synthetic oligonucleotide
cagccacacucugauuuuau

SEQ ID NO: 3320 - RNA, 20 nt, Artificial Sequence
  Description of Artificial Sequence: Synthetic oligonucleotide
ucacuuugcagccacacucu

SEQ ID NO: 3321 - RNA, 20 nt, Artificial Sequence
  Description of Artificial Sequence: Synthetic oligonucleotide
uucacuuugcagccacacuc

SEQ ID NO: 3322 - RNA, 20 nt, Artificial Sequence
  Description of Artificial Sequence: Synthetic oligonucleotide
cuuuucacuuugcagccaca

SEQ ID NO: 3323 - RNA, 20 nt, Artificial Sequence
  Description of Artificial Sequence: Synthetic oligonucleotide
gcuuuucacuuugcagccac

SEQ ID NO: 3324 - RNA, 20 nt, Artificial Sequence
  Description of Artificial Sequence: Synthetic oligonucleotide
uucaggaucauguucaagcu

SEQ ID NO: 3325 - RNA, 20 nt, Artificial Sequence
  Description of Artificial Sequence: Synthetic oligonucleotide
cuucaggaucauguucaagc

SEQ ID NO: 3326 - RNA, 20 nt, Artificial Sequence
  Description of Artificial Sequence: Synthetic oligonucleotide
gcuucaggaucauguucaag

SEQ ID NO: 3327 - RNA, 20 nt, Artificial Sequence
  Description of Artificial Sequence: Synthetic oligonucleotide
cagcuucaggaucauguuca

SEQ ID NO: 3328 - RNA, 20 nt, Artificial Sequence
  Description of Artificial Sequence: Synthetic oligonucleotide
ucagcuucaggaucauguuc

SEQ ID NO: 3329 - RNA, 20 nt, Artificial Sequence
  Description of Artificial Sequence: Synthetic oligonucleotide
gucagcuucaggaucauguu

SEQ ID NO: 3330 - RNA, 20 nt, Artificial Sequence
  Description of Artificial Sequence: Synthetic oligonucleotide
gcgucagcuucaggaucaug

SEQ ID NO: 3331 - RNA, 20 nt, Artificial Sequence
  Description of Artificial Sequence: Synthetic oligonucleotide
ugcgucagcuucaggaucau

SEQ ID NO: 3332 - RNA, 20 nt, Artificial Sequence
  Description of Artificial Sequence: Synthetic oligonucleotide
uugcgucagcuucaggauca

SEQ ID NO: 3333 - RNA, 20 nt, Artificial Sequence
  Description of Artificial Sequence: Synthetic oligonucleotide
guugcgucagcuucaggauc

SEQ ID NO: 3334 - RNA, 20 nt, Artificial Sequence
  Description of Artificial Sequence: Synthetic oligonucleotide
uguugcgucagcuucaggau

SEQ ID NO: 3335 - RNA, 20 nt, Artificial Sequence
  Description of Artificial Sequence: Synthetic oligonucleotide
cuguugcgucagcuucagga

SEQ ID NO: 3336 - RNA, 20 nt, Artificial Sequence
  Description of Artificial Sequence: Synthetic oligonucleotide
uccuguugcgucagcuucag

SEQ ID NO: 3337 - RNA, 20 nt, Artificial Sequence
  Description of Artificial Sequence: Synthetic oligonucleotide
auccuguugcgucagcuuca

SEQ ID NO: 3338 - RNA, 20 nt, Artificial Sequence
  Description of Artificial Sequence: Synthetic oligonucleotide
ucauccuguugcgucagcuu

SEQ ID NO: 3339 - RNA, 20 nt, Artificial Sequence
  Description of Artificial Sequence: Synthetic oligonucleotide
uucauccuguugcgucagcu

SEQ ID NO: 3340 - RNA, 20 nt, Artificial Sequence
  Description of Artificial Sequence: Synthetic oligonucleotide
uuucauccuguugcgucagc

SEQ ID NO: 3341 - RNA, 20 nt, Artificial Sequence
  Description of Artificial Sequence: Synthetic oligonucleotide
uuuucauccuguugcgucag

SEQ ID NO: 3342 - RNA, 20 nt, Artificial Sequence
  Description of Artificial Sequence: Synthetic oligonucleotide
auuuucauccuguugcguca

SEQ ID NO: 3343 - RNA, 20 nt, Artificial Sequence
  Description of Artificial Sequence: Synthetic oligonucleotide
cauuccguuugauguagcau

SEQ ID NO: 3344 - RNA, 20 nt, Artificial Sequence
  Description of Artificial Sequence: Synthetic oligonucleotide
uugcuagauggagaugaagu

SEQ ID NO: 3345 - RNA, 20 nt, Artificial Sequence
  Description of Artificial Sequence: Synthetic oligonucleotide
uuugcuagauggagaugaag

SEQ ID NO: 3346 - RNA, 20 nt, Artificial Sequence
  Description of Artificial Sequence: Synthetic oligonucleotide
cauuugcuagauggagauga

SEQ ID NO: 3347 - RNA, 20 nt, Artificial Sequence
  Description of Artificial Sequence: Synthetic oligonucleotide
ucauuugcuagauggagaug

SEQ ID NO: 3348 - RNA, 20 nt, Artificial Sequence
  Description of Artificial Sequence: Synthetic oligonucleotide
gccucauuugcuagauggag

SEQ ID NO: 3349 - RNA, 20 nt, Artificial Sequence
  Description of Artificial Sequence: Synthetic oligonucleotide
ugccucauuugcuagaugga

SEQ ID NO: 3350 - RNA, 20 nt, Artificial Sequence
  Description of Artificial Sequence: Synthetic oligonucleotide
gugccucauuugcuagaugg

SEQ ID NO: 3351 - RNA, 20 nt, Artificial Sequence
  Description of Artificial Sequence: Synthetic oligonucleotide
agaacagugccucauuugcu

SEQ ID NO: 3352 - RNA, 20 nt, Artificial Sequence
  Description of Artificial Sequence: Synthetic oligonucleotide
gagaacagugccucauuugc

SEQ ID NO: 3353 - RNA, 20 nt, Artificial Sequence
  Description of Artificial Sequence: Synthetic oligonucleotide
uugguugagaacagugccuc

SEQ ID NO: 3354 - RNA, 20 nt, Artificial Sequence
  Description of Artificial Sequence: Synthetic oligonucleotide
uuugguugagaacagugccu

SEQ ID NO: 3355 - RNA, 20 nt, Artificial Sequence
  Description of Artificial Sequence: Synthetic oligonucleotide
cuuugguugagaacagugcc

SEQ ID NO: 3356 - RNA, 20 nt, Artificial Sequence
  Description of Artificial Sequence: Synthetic oligonucleotide
gaccacagcacaucaaauua

SEQ ID NO: 3357 - RNA, 20 nt, Artificial Sequence
  Description of Artificial Sequence: Synthetic oligonucleotide
caaggagaccacagcacauc

SEQ ID NO: 3358 - RNA, 20 nt, Artificial Sequence
  Description of Artificial Sequence: Synthetic oligonucleotide
ccaaggagaccacagcacau

SEQ ID NO: 3359 - RNA, 20 nt, Artificial Sequence
  Description of Artificial Sequence: Synthetic oligonucleotide
accaaggagaccacagcaca

SEQ ID NO: 3360 - RNA, 20 nt, Artificial Sequence
  Description of Artificial Sequence: Synthetic oligonucleotide
uuaccaaggagaccacagca

SEQ ID NO: 3361 - RNA, 20 nt, Artificial Sequence
  Description of Artificial Sequence: Synthetic oligonucleotide
cauuaccaaggagaccacag

SEQ ID NO: 3362 - RNA, 20 nt, Artificial Sequence
  Description of Artificial Sequence: Synthetic oligonucleotide
acauuaccaaggagaccaca

SEQ ID NO: 3363 - RNA, 20 nt, Artificial Sequence
  Description of Artificial Sequence: Synthetic oligonucleotide
uacauuaccaaggagaccac

SEQ ID NO: 3364 - RNA, 20 nt, Artificial Sequence
  Description of Artificial Sequence: Synthetic oligonucleotide
auacauuaccaaggagacca

SEQ ID NO: 3365 - RNA, 20 nt, Artificial Sequence
  Description of Artificial Sequence: Synthetic oligonucleotide
caccugugcaauaccaaauu

SEQ ID NO: 3366 - RNA, 20 nt, Artificial Sequence
  Description of Artificial Sequence: Synthetic oligonucleotide
ucaccugugcaauaccaaau

SEQ ID NO: 3367 - RNA, 20 nt, Artificial Sequence
  Description of Artificial Sequence: Synthetic oligonucleotide
aucaccugugcaauaccaaa

SEQ ID NO: 3368 - RNA, 20 nt, Artificial Sequence
  Description of Artificial Sequence: Synthetic oligonucleotide
aaucaccugugcaauaccaa

SEQ ID NO: 3369 - RNA, 20 nt, Artificial Sequence
  Description of Artificial Sequence: Synthetic oligonucleotide
acuaaucaccugugcaauac

SEQ ID NO: 3370 - RNA, 20 nt, Artificial Sequence
  Description of Artificial Sequence: Synthetic oligonucleotide
gacuaaucaccugugcaaua

SEQ ID NO: 3371 - RNA, 20 nt, Artificial Sequence
  Description of Artificial Sequence: Synthetic oligonucleotide
ugacuaaucaccugugcaau

SEQ ID NO: 3372 - RNA, 20 nt, Artificial Sequence
  Description of Artificial Sequence: Synthetic oligonucleotide
uugacuaaucaccugugcaa

SEQ ID NO: 3373 - RNA, 20 nt, Artificial Sequence
  Description of Artificial Sequence: Synthetic oligonucleotide
ccuugacuaaucaccugugc

SEQ ID NO: 3374 - RNA, 20 nt, Artificial Sequence
  Description of Artificial Sequence: Synthetic oligonucleotide
uccuugacuaaucaccugug

SEQ ID NO: 3375 - RNA, 20 nt, Artificial Sequence
  Description of Artificial Sequence: Synthetic oligonucleotide
uuccuugacuaaucaccugu

SEQ ID NO: 3376 - RNA, 20 nt, Artificial Sequence
  Description of Artificial Sequence: Synthetic oligonucleotide
cuuccuugacuaaucaccug

SEQ ID NO: 3377 - RNA, 20 nt, Artificial Sequence
  Description of Artificial Sequence: Synthetic oligonucleotide
acuuccuugacuaaucaccu

SEQ ID NO: 3378 - RNA, 20 nt, Artificial Sequence
  Description of Artificial Sequence: Synthetic oligonucleotide
gacuuccuugacuaaucacc

SEQ ID NO: 3379 - RNA, 20 nt, Artificial Sequence
  Description of Artificial Sequence: Synthetic oligonucleotide
agacuuccuugacuaaucac

SEQ ID NO: 3380 - RNA, 20 nt, Artificial Sequence
  Description of Artificial Sequence: Synthetic oligonucleotide
cagacuuccuugacuaauca

SEQ ID NO: 3381 - RNA, 20 nt, Artificial Sequence
  Description of Artificial Sequence: Synthetic oligonucleotide
aaggcugugggaccaaagcu

SEQ ID NO: 3382 - RNA, 20 nt, Artificial Sequence
  Description of Artificial Sequence: Synthetic oligonucleotide
gcaaggcugugggaccaaag

SEQ ID NO: 3383 - RNA, 20 nt, Artificial Sequence
  Description of Artificial Sequence: Synthetic oligonucleotide
ggcaaggcugugggaccaaa

SEQ ID NO: 3384 - RNA, 20 nt, Artificial Sequence
  Description of Artificial Sequence: Synthetic oligonucleotide
ugcugugaggcaaggcugug

SEQ ID NO: 3385 - RNA, 20 nt, Artificial Sequence
  Description of Artificial Sequence: Synthetic oligonucleotide
caugcugugaggcaaggcug

SEQ ID NO: 3386 - RNA, 20 nt, Artificial Sequence
  Description of Artificial Sequence: Synthetic oligonucleotide
acaugcugugaggcaaggcu

SEQ ID NO: 3387 - RNA, 20 nt, Artificial Sequence
  Description of Artificial Sequence: Synthetic oligonucleotide
uuuacaugcugugaggcaag

SEQ ID NO: 3388 - RNA, 20 nt, Artificial Sequence
  Description of Artificial Sequence: Synthetic oligonucleotide
auuuacaugcugugaggcaa

SEQ ID NO: 3389 - RNA, 20 nt, Artificial Sequence
  Description of Artificial Sequence: Synthetic oligonucleotide
gaagaaccucagcaucaaua

SEQ ID NO: 3390 - RNA, 20 nt, Artificial Sequence
  Description of Artificial Sequence: Synthetic oligonucleotide
agaagaaccucagcaucaau

SEQ ID NO: 3391 - RNA, 20 nt, Artificial Sequence
  Description of Artificial Sequence: Synthetic oligonucleotide
uagaagaaccucagcaucaa

SEQ ID NO: 3392 - RNA, 20 nt, Artificial Sequence
  Description of Artificial Sequence: Synthetic oligonucleotide
caguagaagaaccucagcau

SEQ ID NO: 3393 - RNA, 20 nt, Artificial Sequence
  Description of Artificial Sequence: Synthetic oligonucleotide
cuagcaguagaagaaccuca

SEQ ID NO: 3394 - RNA, 20 nt, Artificial Sequence
  Description of Artificial Sequence: Synthetic oligonucleotide
acuagcaguagaagaaccuc

SEQ ID NO: 3395 - RNA, 20 nt, Artificial Sequence
  Description of Artificial Sequence: Synthetic oligonucleotide
gucacuuucauacuagcagu

SEQ ID NO: 3396 - RNA, 20 nt, Artificial Sequence
  Description of Artificial Sequence: Synthetic oligonucleotide
cccaauucacaccaguaaaa

SEQ ID NO: 3397 - RNA, 20 nt, Artificial Sequence
  Description of Artificial Sequence: Synthetic oligonucleotide
ucccaauucacaccaguaaa

SEQ ID NO: 3398 - RNA, 20 nt, Artificial Sequence
  Description of Artificial Sequence: Synthetic oligonucleotide
cuucccaauucacaccagua

SEQ ID NO: 3399 - RNA, 20 nt, Artificial Sequence
  Description of Artificial Sequence: Synthetic oligonucleotide
cgucauggaauagcauuguu

SEQ ID NO: 3400 - RNA, 20 nt, Artificial Sequence
  Description of Artificial Sequence: Synthetic oligonucleotide
acgucauggaauagcauugu

SEQ ID NO: 3401 - RNA, 20 nt, Artificial Sequence
  Description of Artificial Sequence: Synthetic oligonucleotide
caaacgucauggaauagcau

SEQ ID NO: 3402 - RNA, 20 nt, Artificial Sequence
  Description of Artificial Sequence: Synthetic oligonucleotide
acaaacgucauggaauagca

SEQ ID NO: 3403 - RNA, 20 nt, Artificial Sequence
  Description of Artificial Sequence: Synthetic oligonucleotide
uacaaacgucauggaauagc

SEQ ID NO: 3404 - RNA, 20 nt, Artificial Sequence
  Description of Artificial Sequence: Synthetic oligonucleotide
cacauagucaaggaccuuaa

SEQ ID NO: 3405 - RNA, 20 nt, Artificial Sequence
  Description of Artificial Sequence: Synthetic oligonucleotide
acacauagucaaggaccuua

SEQ ID NO: 3406 - RNA, 20 nt, Artificial Sequence
  Description of Artificial Sequence: Synthetic oligonucleotide
uacacauagucaaggaccuu

SEQ ID NO: 3407 - RNA, 20 nt, Artificial Sequence
  Description of Artificial Sequence: Synthetic oligonucleotide
guacacauagucaaggaccu

SEQ ID NO: 3408 - RNA, 20 nt, Artificial Sequence
  Description of Artificial Sequence: Synthetic oligonucleotide
cgagauggcagagauuaacu

SEQ ID NO: 3409 - RNA, 20 nt, Artificial Sequence
  Description of Artificial Sequence: Synthetic oligonucleotide
gcgagauggcagagauuaac

SEQ ID NO: 3410 - RNA, 20 nt, Artificial Sequence
  Description of Artificial Sequence: Synthetic oligonucleotide
auuuagcgagauggcagaga

SEQ ID NO: 3411 - RNA, 20 nt, Artificial Sequence
  Description of Artificial Sequence: Synthetic oligonucleotide
gauuuagcgagauggcagag

SEQ ID NO: 3412 - RNA, 20 nt, Artificial Sequence
  Description of Artificial Sequence: Synthetic oligonucleotide
ugauuuagcgagauggcaga

SEQ ID NO: 3413 - RNA, 20 nt, Artificial Sequence
  Description of Artificial Sequence: Synthetic oligonucleotide
augauuuagcgagauggcag

SEQ ID NO: 3414 - RNA, 20 nt, Artificial Sequence
  Description of Artificial Sequence: Synthetic oligonucleotide
gaugauuuagcgagauggca

SEQ ID NO: 3415 - RNA, 20 nt, Artificial Sequence
  Description of Artificial Sequence: Synthetic oligonucleotide
ugaugauuuagcgagauggc

SEQ ID NO: 3416 - RNA, 20 nt, Artificial Sequence
  Description of Artificial Sequence: Synthetic oligonucleotide
cugaugauuuagcgagaugg

SEQ ID NO: 3417 - RNA, 20 nt, Artificial Sequence
  Description of Artificial Sequence: Synthetic oligonucleotide
acugaugauuuagcgagaug

SEQ ID NO: 3418 - RNA, 20 nt, Artificial Sequence
  Description of Artificial Sequence: Synthetic oligonucleotide
gacugaugauuuagcgagau

SEQ ID NO: 3419 - RNA, 20 nt, Artificial Sequence
  Description of Artificial Sequence: Synthetic oligonucleotide
agacugaugauuuagcgaga

SEQ ID NO: 3420 - RNA, 20 nt, Artificial Sequence
  Description of Artificial Sequence: Synthetic oligonucleotide
gaucaggcaccuucuauuuc

SEQ ID NO: 3421 - RNA, 20 nt, Artificial Sequence
  Description of Artificial Sequence: Synthetic oligonucleotide
agaucaggcaccuucuauuu

SEQ ID NO: 3422 - RNA, 20 nt, Artificial Sequence
  Description of Artificial Sequence: Synthetic oligonucleotide
uuaggaagaucaggcaccuu

SEQ ID NO: 3423 - RNA, 20 nt, Artificial Sequence
  Description of Artificial Sequence: Synthetic oligonucleotide
auuaggaagaucaggcaccu

SEQ ID NO: 3424 - RNA, 20 nt, Artificial Sequence
  Description of Artificial Sequence: Synthetic oligonucleotide
uauuaggaagaucaggcacc

SEQ ID NO: 3425 - RNA, 20 nt, Artificial Sequence
  Description of Artificial Sequence: Synthetic oligonucleotide
gcagcacaucuuauuuggga

SEQ ID NO: 3426 - RNA, 20 nt, Artificial Sequence
  Description of Artificial Sequence: Synthetic oligonucleotide
agcagcacaucuuauuuggg

SEQ ID NO: 3427 - RNA, 20 nt, Artificial Sequence
  Description of Artificial Sequence: Synthetic oligonucleotide
aagcagcacaucuuauuugg

SEQ ID NO: 3428 - RNA, 20 nt, Artificial Sequence
  Description of Artificial Sequence: Synthetic oligonucleotide
cucgguaagcagcacaucuu

SEQ ID NO: 3429 - RNA, 20 nt, Artificial Sequence
  Description of Artificial Sequence: Synthetic oligonucleotide
ccucgguaagcagcacaucu

SEQ ID NO: 3430 - RNA, 20 nt, Artificial Sequence
  Description of Artificial Sequence: Synthetic oligonucleotide
accucgguaagcagcacauc

SEQ ID NO: 3431 - RNA, 20 nt, Artificial Sequence
  Description of Artificial Sequence: Synthetic oligonucleotide
uaccucgguaagcagcacau

SEQ ID NO: 3432 - RNA, 20 nt, Artificial Sequence
  Description of Artificial Sequence: Synthetic oligonucleotide
auaccucgguaagcagcaca

SEQ ID NO: 3433 - RNA, 20 nt, Artificial Sequence
  Description of Artificial Sequence: Synthetic oligonucleotide
gauaccucgguaagcagcac

SEQ ID NO: 3434 - RNA, 20 nt, Artificial Sequence
  Description of Artificial Sequence: Synthetic oligonucleotide
ugauaccucgguaagcagca

SEQ ID NO: 3435 - RNA, 20 nt, Artificial Sequence
  Description of Artificial Sequence: Synthetic oligonucleotide
gugauaccucgguaagcagc

SEQ ID NO: 3436 - RNA, 20 nt, Artificial Sequence
  Description of Artificial Sequence: Synthetic oligonucleotide
cgugauaccucgguaagcag

SEQ ID NO: 3437 - RNA, 20 nt, Artificial Sequence
  Description of Artificial Sequence: Synthetic oligonucleotide
ccgugauaccucgguaagca

SEQ ID NO: 3438 - RNA, 20 nt, Artificial Sequence
  Description of Artificial Sequence: Synthetic oligonucleotide
cccgugauaccucgguaagc

SEQ ID NO: 3439 - RNA, 20 nt, Artificial Sequence
  Description of Artificial Sequence: Synthetic oligonucleotide
ucaacgacccaagcuggagc

SEQ ID NO: 3440 - RNA, 20 nt, Artificial Sequence
  Description of Artificial Sequence: Synthetic oligonucleotide
uucaacgacccaagcuggag

SEQ ID NO: 3441 - RNA, 20 nt, Artificial Sequence
  Description of Artificial Sequence: Synthetic oligonucleotide
cuucaacgacccaagcugga

SEQ ID NO: 3442 - RNA, 20 nt, Artificial Sequence
  Description of Artificial Sequence: Synthetic oligonucleotide
cccagcuucaacgacccaag

SEQ ID NO: 3443 - RNA, 20 nt, Artificial Sequence
  Description of Artificial Sequence: Synthetic oligonucleotide
ucucugaagugguuucccaa

SEQ ID NO: 3444 - RNA, 20 nt, Artificial Sequence
  Description of Artificial Sequence: Synthetic oligonucleotide
aucucugaagugguuuccca

SEQ ID NO: 3445 - RNA, 20 nt, Artificial Sequence
  Description of Artificial Sequence: Synthetic oligonucleotide
caucucugaagugguuuccc

SEQ ID NO: 3446 - RNA, 20 nt, Artificial Sequence
  Description of Artificial Sequence: Synthetic oligonucleotide
gauggcauugugcucauaau

SEQ ID NO: 3447 - RNA, 20 nt, Artificial Sequence
  Description of Artificial Sequence: Synthetic oligonucleotide
ugauggcauugugcucauaa

SEQ ID NO: 3448 - RNA, 20 nt, Artificial Sequence
  Description of Artificial Sequence: Synthetic oligonucleotide
gugauggcauugugcucaua

SEQ ID NO: 3449 - RNA, 20 nt, Artificial Sequence
  Description of Artificial Sequence: Synthetic oligonucleotide
guuaagugauggcauugugc

SEQ ID NO: 3450 - RNA, 20 nt, Artificial Sequence
  Description of Artificial Sequence: Synthetic oligonucleotide
aguuaagugauggcauugug

SEQ ID NO: 3451 - RNA, 20 nt, Artificial Sequence
  Description of Artificial Sequence: Synthetic oligonucleotide
gagucuauuuggucaagaga

SEQ ID NO: 3452 - RNA, 20 nt, Artificial Sequence
  Description of Artificial Sequence: Synthetic oligonucleotide
ugagucuauuuggucaagag

SEQ ID NO: 3453 - RNA, 20 nt, Artificial Sequence
  Description of Artificial Sequence: Synthetic oligonucleotide
ccauaacucacucacuagaa

SEQ ID NO: 3454 - RNA, 20 nt, Artificial Sequence
  Description of Artificial Sequence: Synthetic oligonucleotide
agcaccauaacucacucacu

SEQ ID NO: 3455 - RNA, 20 nt, Artificial Sequence
  Description of Artificial Sequence: Synthetic oligonucleotide
ccagcaccauaacucacuca

SEQ ID NO: 3456 - RNA, 20 nt, Artificial Sequence
  Description of Artificial Sequence: Synthetic oligonucleotide
gccagcaccauaacucacuc

SEQ ID NO: 3457 - RNA, 20 nt, Artificial Sequence
  Description of Artificial Sequence: Synthetic oligonucleotide
agccagcaccauaacucacu

SEQ ID NO: 3458 - RNA, 20 nt, Artificial Sequence
  Description of Artificial Sequence: Synthetic oligonucleotide
uagccagcaccauaacucac

SEQ ID NO: 3459 - RNA, 20 nt, Artificial Sequence
  Description of Artificial Sequence: Synthetic oligonucleotide
auagccagcaccauaacuca

SEQ ID NO: 3460 - RNA, 20 nt, Artificial Sequence
  Description of Artificial Sequence: Synthetic oligonucleotide
uauagccagcaccauaacuc

SEQ ID NO: 3461 - RNA, 20 nt, Artificial Sequence
  Description of Artificial Sequence: Synthetic oligonucleotide
aauauagccagcaccauaac

SEQ ID NO: 3462 - RNA, 20 nt, Artificial Sequence
  Description of Artificial Sequence: Synthetic oligonucleotide
caaaauauagccagcaccau

SEQ ID NO: 3463 - RNA, 20 nt, Artificial Sequence
  Description of Artificial Sequence: Synthetic oligonucleotide
gcaaaauauagccagcacca

SEQ ID NO: 3464 - RNA, 20 nt, Artificial Sequence
  Description of Artificial Sequence: Synthetic oligonucleotide
gcaacauuugagagggcagu

SEQ ID NO: 3465 - RNA, 20 nt, Artificial Sequence
  Description of Artificial Sequence: Synthetic oligonucleotide
agcaacauuugagagggcag

SEQ ID NO: 3466 - RNA, 20 nt, Artificial Sequence
  Description of Artificial Sequence: Synthetic oligonucleotide
uagcaacauuugagagggca

SEQ ID NO: 3467 - RNA, 20 nt, Artificial Sequence
  Description of Artificial Sequence: Synthetic oligonucleotide
cuagcaacauuugagagggc

SEQ ID NO: 3468 - RNA, 20 nt, Artificial Sequence
  Description of Artificial Sequence: Synthetic oligonucleotide
ccuagcaacauuugagaggg

SEQ ID NO: 3469 - RNA, 20 nt, Artificial Sequence
  Description of Artificial Sequence: Synthetic oligonucleotide
uccuagcaacauuugagagg

SEQ ID NO: 3470 - RNA, 20 nt, Artificial Sequence
  Description of Artificial Sequence: Synthetic oligonucleotide
uuccuagcaacauuugagag

SEQ ID NO: 3471 - RNA, 20 nt, Artificial Sequence
  Description of Artificial Sequence: Synthetic oligonucleotide
aaauucuggcaagcaaggcc

SEQ ID NO: 3472 - RNA, 20 nt, Artificial Sequence
  Description of Artificial Sequence: Synthetic oligonucleotide
ucaaauucuggcaagcaagg

SEQ ID NO: 3473 - RNA, 20 nt, Artificial Sequence
  Description of Artificial Sequence: Synthetic oligonucleotide
agucaaauucuggcaagcaa

SEQ ID NO: 3474 - RNA, 20 nt, Artificial Sequence
  Description of Artificial Sequence: Synthetic oligonucleotide
aagucaaauucuggcaagca

SEQ ID NO: 3475 - RNA, 20 nt, Artificial Sequence
  Description of Artificial Sequence: Synthetic oligonucleotide
aaagucaaauucuggcaagc

SEQ ID NO: 3476 - RNA, 20 nt, Artificial Sequence
  Description of Artificial Sequence: Synthetic oligonucleotide
cugaaaccugacaccguaua

SEQ ID NO: 3477 - RNA, 20 nt, Artificial Sequence
  Description of Artificial Sequence: Synthetic oligonucleotide
ccugaaaccugacaccguau

SEQ ID NO: 3478 - RNA, 20 nt, Artificial Sequence
  Description of Artificial Sequence: Synthetic oligonucleotide
cccugaaaccugacaccgua

SEQ ID NO: 3479 - RNA, 20 nt, Artificial Sequence
  Description of Artificial Sequence: Synthetic oligonucleotide
acccugaaaccugacaccgu

SEQ ID NO: 3480 - RNA, 20 nt, Artificial Sequence
  Description of Artificial Sequence: Synthetic oligonucleotide
caccaaagaguucuggacuu

SEQ ID NO: 3481 - RNA, 20 nt, Artificial Sequence
  Description of Artificial Sequence: Synthetic oligonucleotide
ucaccaaagaguucuggacu

SEQ ID NO: 3482 - RNA, 20 nt, Artificial Sequence
  Description of Artificial Sequence: Synthetic oligonucleotide
gucaccaaagaguucuggac

SEQ ID NO: 3483 - RNA, 20 nt, Artificial Sequence
  Description of Artificial Sequence: Synthetic oligonucleotide
agucaccaaagaguucugga

SEQ ID NO: 3484 - RNA, 20 nt, Artificial Sequence
  Description of Artificial Sequence: Synthetic oligonucleotide
aaaacggcuuuacaggguau

SEQ ID NO: 3485 - RNA, 20 nt, Artificial Sequence
  Description of Artificial Sequence: Synthetic oligonucleotide
gaccauagguuguuucauac

SEQ ID NO: 3486 - RNA, 20 nt, Artificial Sequence
  Description of Artificial Sequence: Synthetic oligonucleotide
cagaccauagguuguuucau

SEQ ID NO: 3487 - RNA, 20 nt, Artificial Sequence
  Description of Artificial Sequence: Synthetic oligonucleotide
ccagaccauagguuguuuca

SEQ ID NO: 3488 - RNA, 20 nt, Artificial Sequence
  Description of Artificial Sequence: Synthetic oligonucleotide
uccagaccauagguuguuuc

SEQ ID NO: 3489 - RNA, 20 nt, Artificial Sequence
  Description of Artificial Sequence: Synthetic oligonucleotide
uuccagaccauagguuguuu

SEQ ID NO: 3490 - RNA, 20 nt, Artificial Sequence
  Description of Artificial Sequence: Synthetic oligonucleotide
uuuccagaccauagguuguu

SEQ ID NO: 3491 - RNA, 20 nt, Artificial Sequence
  Description of Artificial Sequence: Synthetic oligonucleotide
auuuccagaccauagguugu

SEQ ID NO: 3492 - RNA, 20 nt, Artificial Sequence
  Description of Artificial Sequence: Synthetic oligonucleotide
aauuuccagaccauagguug

SEQ ID NO: 3493 - RNA, 20 nt, Artificial Sequence
  Description of Artificial Sequence: Synthetic oligonucleotide
cacauauagcuuugcgauac

SEQ ID NO: 3494 - RNA, 20 nt, Artificial Sequence
  Description of Artificial Sequence: Synthetic oligonucleotide
gcacauauagcuuugcgaua

SEQ ID NO: 3495 - RNA, 20 nt, Artificial Sequence
  Description of Artificial Sequence: Synthetic oligonucleotide
ugcacauauagcuuugcgau

SEQ ID NO: 3496 - RNA, 20 nt, Artificial Sequence
  Description of Artificial Sequence: Synthetic oligonucleotide
augcacauauagcuuugcga

SEQ ID NO: 3497 - RNA, 20 nt, Artificial Sequence
  Description of Artificial Sequence: Synthetic oligonucleotide
uaugcacauauagcuuugcg

SEQ ID NO: 3498 - RNA, 20 nt, Artificial Sequence
  Description of Artificial Sequence: Synthetic oligonucleotide
gcaaacucaaagcauagauc

SEQ ID NO: 3499 - RNA, 19 nt, Artificial Sequence
  Description of Artificial Sequence: Synthetic oligonucleotide
aaaggcgugcacuuccuac

SEQ ID NO: 3500 - RNA, 19 nt, Artificial Sequence
  Description of Artificial Sequence: Synthetic oligonucleotide
guaggaagugcacgccuuu

SEQ ID NO: 3501 - RNA, 19 nt, Artificial Sequence
  Description of Artificial Sequence: Synthetic oligonucleotide
aaggcgugcacuuccuacg

SEQ ID NO: 3502 - RNA, 19 nt, Artificial Sequence
  Description of Artificial Sequence: Synthetic oligonucleotide
cguaggaagugcacgccuu

SEQ ID NO: 3503 - RNA, 19 nt, Artificial Sequence
  Description of Artificial Sequence: Synthetic oligonucleotide
cgugcacuuccuacgccug

SEQ ID NO: 3504 - RNA, 19 nt, Artificial Sequence
  Description of Artificial Sequence: Synthetic oligonucleotide
caggcguaggaagugcacg

SEQ ID NO: 3505 - RNA, 19 nt, Artificial Sequence
  Description of Artificial Sequence: Synthetic oligonucleotide
gugcacuuccuacgccuga

SEQ ID NO: 3506 - RNA, 19 nt, Artificial Sequence
  Description of Artificial Sequence: Synthetic oligonucleotide
ucaggcguaggaagugcac

SEQ ID NO: 3507 - RNA, 19 nt, Artificial Sequence
  Description of Artificial Sequence: Synthetic oligonucleotide
ugcacuuccuacgccugau

SEQ ID NO: 3508 - RNA, 19 nt, Artificial Sequence
  Description of Artificial Sequence: Synthetic oligonucleotide
aucaggcguaggaagugca

SEQ ID NO: 3509 - RNA, 19 nt, Artificial Sequence
  Description of Artificial Sequence: Synthetic oligonucleotide
ucgcaaccucgcagcuucc

SEQ ID NO: 3510 - RNA, 19 nt, Artificial Sequence
  Description of Artificial Sequence: Synthetic oligonucleotide
ggaagcugcgagguugcga

SEQ ID NO: 3511 - RNA, 19 nt, Artificial Sequence
  Description of Artificial Sequence: Synthetic oligonucleotide
cggcgugcagcgcucauuu

SEQ ID NO: 3512 - RNA, 19 nt, Artificial Sequence
  Description of Artificial Sequence: Synthetic oligonucleotide
aaaugagcgcugcacgccg

SEQ ID NO: 3513 - RNA, 19 nt, Artificial Sequence
  Description of Artificial Sequence: Synthetic oligonucleotide
ggcgugcagcgcucauuua

SEQ ID NO: 3514 - RNA, 19 nt, Artificial Sequence
  Description of Artificial Sequence: Synthetic oligonucleotide
uaaaugagcgcugcacgcc

SEQ ID NO: 3515 - RNA, 19 nt, Artificial Sequence
  Description of Artificial Sequence: Synthetic oligonucleotide
gcgugcagcgcucauuuac

SEQ ID NO: 3516 - RNA, 19 nt, Artificial Sequence
  Description of Artificial Sequence: Synthetic oligonucleotide
guaaaugagcgcugcacgc

SEQ ID NO: 3517 - RNA, 19 nt, Artificial Sequence
  Description of Artificial Sequence: Synthetic oligonucleotide
cgugcagcgcucauuuacc

SEQ ID NO: 3518 - RNA, 19 nt, Artificial Sequence
  Description of Artificial Sequence: Synthetic oligonucleotide
gguaaaugagcgcugcacg

SEQ ID NO: 3519 - RNA, 19 nt, Artificial Sequence
  Description of Artificial Sequence: Synthetic oligonucleotide
gugcagcgcucauuuacca

SEQ ID NO: 3520 - RNA, 19 nt, Artificial Sequence
  Description of Artificial Sequence: Synthetic oligonucleotide
ugguaaaugagcgcugcac

SEQ ID NO: 3521 - RNA, 19 nt, Artificial Sequence
  Description of Artificial Sequence: Synthetic oligonucleotide
ugcagcgcucauuuaccaa

SEQ ID NO: 3522 - RNA, 19 nt, Artificial Sequence
  Description of Artificial Sequence: Synthetic oligonucleotide
uugguaaaugagcgcugca

SEQ ID NO: 3523 - RNA, 19 nt, Artificial Sequence
  Description of Artificial Sequence: Synthetic oligonucleotide
gcagcgcucauuuaccaau

SEQ ID NO: 3524 - RNA, 19 nt, Artificial Sequence
  Description of Artificial Sequence: Synthetic oligonucleotide
auugguaaaugagcgcugc

SEQ ID NO: 3525 - RNA, 19 nt, Artificial Sequence
  Description of Artificial Sequence: Synthetic oligonucleotide
cagcgcucauuuaccaauu

SEQ ID NO: 3526 - RNA, 19 nt, Artificial Sequence
  Description of Artificial Sequence: Synthetic oligonucleotide
aauugguaaaugagcgcug

SEQ ID NO: 3527 - RNA, 19 nt, Artificial Sequence
  Description of Artificial Sequence: Synthetic oligonucleotide
gcucauuuaccaauucccu

SEQ ID NO: 3528 - RNA, 19 nt, Artificial Sequence
  Description of Artificial Sequence: Synthetic oligonucleotide
agggaauugguaaaugagc

SEQ ID NO: 3529 - RNA, 19 nt, Artificial Sequence
  Description of Artificial Sequence: Synthetic oligonucleotide
cucauuuaccaauucccuu

SEQ ID NO: 3530 - RNA, 19 nt, Artificial Sequence
  Description of Artificial Sequence: Synthetic oligonucleotide
aagggaauugguaaaugag

SEQ ID NO: 3531 - RNA, 19 nt, Artificial Sequence
  Description of Artificial Sequence: Synthetic oligonucleotide
ucauuuaccaauucccuuc

SEQ ID NO: 3532 - RNA, 19 nt, Artificial Sequence
  Description of Artificial Sequence: Synthetic oligonucleotide
gaagggaauugguaaauga

SEQ ID NO: 3533 - RNA, 19 nt, Artificial Sequence
  Description of Artificial Sequence: Synthetic oligonucleotide
cauuuaccaauucccuucc

SEQ ID NO: 3534 - RNA, 19 nt, Artificial Sequence
  Description of Artificial Sequence: Synthetic oligonucleotide
ggaagggaauugguaaaug

SEQ ID NO: 3535 - RNA, 19 nt, Artificial Sequence
  Description of Artificial Sequence: Synthetic oligonucleotide
auuuaccaauucccuuccu

SEQ ID NO: 3536 - RNA, 19 nt, Artificial Sequence
  Description of Artificial Sequence: Synthetic oligonucleotide
aggaagggaauugguaaau

SEQ ID NO: 3537 - RNA, 19 nt, Artificial Sequence
  Description of Artificial Sequence: Synthetic oligonucleotide
cuuccugggaguugcggcu

SEQ ID NO: 3538 - RNA, 19 nt, Artificial Sequence
  Description of Artificial Sequence: Synthetic oligonucleotide
agccgcaacucccaggaag

SEQ ID NO: 3539 - RNA, 19 nt, Artificial Sequence
  Description of Artificial Sequence: Synthetic oligonucleotide
uuccugggaguugcggcuu

SEQ ID NO: 3540 - RNA, 19 nt, Artificial Sequence
  Description of Artificial Sequence: Synthetic oligonucleotide
aagccgcaacucccaggaa

SEQ ID NO: 3541 - RNA, 19 nt, Artificial Sequence
  Description of Artificial Sequence: Synthetic oligonucleotide
uccugggaguugcggcuuc

SEQ ID NO: 3542 - RNA, 19 nt, Artificial Sequence
  Description of Artificial Sequence: Synthetic oligonucleotide
gaagccgcaacucccagga

SEQ ID NO: 3543 - RNA, 19 nt, Artificial Sequence
  Description of Artificial Sequence: Synthetic oligonucleotide
cccacucccguuuacccuu

SEQ ID NO: 3544 - RNA, 19 nt, Artificial Sequence
  Description of Artificial Sequence: Synthetic oligonucleotide
aaggguaaacgggaguggg

SEQ ID NO: 3545 - RNA, 19 nt, Artificial Sequence
  Description of Artificial Sequence: Synthetic oligonucleotide
ccacucccguuuacccuuu

SEQ ID NO: 3546 - RNA, 19 nt, Artificial Sequence
  Description of Artificial Sequence: Synthetic oligonucleotide
aaaggguaaacgggagugg

SEQ ID NO: 3547 - RNA, 19 nt, Artificial Sequence
  Description of Artificial Sequence: Synthetic oligonucleotide
gcuccacuuucacuuucgg

SEQ ID NO: 3548 - RNA, 19 nt, Artificial Sequence
  Description of Artificial Sequence: Synthetic oligonucleotide
ccgaaagugaaaguggagc

SEQ ID NO: 3549 - RNA, 19 nt, Artificial Sequence
  Description of Artificial Sequence: Synthetic oligonucleotide
cuccacuuucacuuucggu

SEQ ID NO: 3550 - RNA, 19 nt, Artificial Sequence
  Description of Artificial Sequence: Synthetic oligonucleotide
accgaaagugaaaguggag

SEQ ID NO: 3551 - RNA, 19 nt, Artificial Sequence
  Description of Artificial Sequence: Synthetic oligonucleotide
acuuucacuuucgguccug

SEQ ID NO: 3552 - RNA, 19 nt, Artificial Sequence
  Description of Artificial Sequence: Synthetic oligonucleotide
caggaccgaaagugaaagu

SEQ ID NO: 3553 - RNA, 19 nt, Artificial Sequence
  Description of Artificial Sequence: Synthetic oligonucleotide
cccagguagguagagcaag

SEQ ID NO: 3554 - RNA, 19 nt, Artificial Sequence
  Description of Artificial Sequence: Synthetic oligonucleotide
cuugcucuaccuaccuggg

SEQ ID NO: 3555 - RNA, 19 nt, Artificial Sequence
  Description of Artificial Sequence: Synthetic oligonucleotide
ccagguagguagagcaaga

SEQ ID NO: 3556 - RNA, 19 nt, Artificial Sequence
  Description of Artificial Sequence: Synthetic oligonucleotide
ucuugcucuaccuaccugg

SEQ ID NO: 3557 - RNA, 19 nt, Artificial Sequence
  Description of Artificial Sequence: Synthetic oligonucleotide
cagguagguagagcaagaa

SEQ ID NO: 3558 - RNA, 19 nt, Artificial Sequence
  Description of Artificial Sequence: Synthetic oligonucleotide
uucuugcucuaccuaccug

SEQ ID NO: 3559 - RNA, 19 nt, Artificial Sequence
  Description of Artificial Sequence: Synthetic oligonucleotide
agguagguagagcaagaag

SEQ ID NO: 3560 - RNA, 19 nt, Artificial Sequence
  Description of Artificial Sequence: Synthetic oligonucleotide
cuucuugcucuaccuaccu

SEQ ID NO: 3561 - RNA, 19 nt, Artificial Sequence
  Description of Artificial Sequence: Synthetic oligonucleotide
gguagagcaagaagauggu

SEQ ID NO: 3562 - RNA, 19 nt, Artificial Sequence
  Description of Artificial Sequence: Synthetic oligonucleotide
accaucuucuugcucuacc

SEQ ID NO: 3563 - RNA, 19 nt, Artificial Sequence
  Description of Artificial Sequence: Synthetic oligonucleotide
guagagcaagaagauggug

SEQ ID NO: 3564 - RNA, 19 nt, Artificial Sequence
  Description of Artificial Sequence: Synthetic oligonucleotide
caccaucuucuugcucuac

SEQ ID NO: 3565 - RNA, 19 nt, Artificial Sequence
  Description of Artificial Sequence: Synthetic oligonucleotide
uagagcaagaagauggugu

SEQ ID NO: 3566 - RNA, 19 nt, Artificial Sequence
  Description of Artificial Sequence: Synthetic oligonucleotide
acaccaucuucuugcucua

SEQ ID NO: 3567 - RNA, 19 nt, Artificial Sequence
  Description of Artificial Sequence: Synthetic oligonucleotide
agagcaagaagaugguguu

SEQ ID NO: 3568 - RNA, 19 nt, Artificial Sequence
  Description of Artificial Sequence: Synthetic oligonucleotide
aacaccaucuucuugcucu

SEQ ID NO: 3569 - RNA, 19 nt, Artificial Sequence
  Description of Artificial Sequence: Synthetic oligonucleotide
gagcaagaagaugguguuu

SEQ ID NO: 3570 - RNA, 19 nt, Artificial Sequence
  Description of Artificial Sequence: Synthetic oligonucleotide
aaacaccaucuucuugcuc

SEQ ID NO: 3571 - RNA, 19 nt, Artificial Sequence
  Description of Artificial Sequence: Synthetic oligonucleotide
gaagaugguguuucugccc

SEQ ID NO: 3572 - RNA, 19 nt, Artificial Sequence
  Description of Artificial Sequence: Synthetic oligonucleotide
gggcagaaacaccaucuuc

SEQ ID NO: 3573 - RNA, 19 nt, Artificial Sequence
  Description of Artificial Sequence: Synthetic oligonucleotide
ucacuguuggcucucuuaa

SEQ ID NO: 3574 - RNA, 19 nt, Artificial Sequence
  Description of Artificial Sequence: Synthetic oligonucleotide
uuaagagagccaacaguga

SEQ ID NO: 3575 - RNA, 19 nt, Artificial Sequence
  Description of Artificial Sequence: Synthetic oligonucleotide
cacuguuggcucucuuaac

SEQ ID NO: 3576 - RNA, 19 nt, Artificial Sequence
  Description of Artificial Sequence: Synthetic oligonucleotide
guuaagagagccaacagug

SEQ ID NO: 3577 - RNA, 19 nt, Artificial Sequence
  Description of Artificial Sequence: Synthetic oligonucleotide
acuguuggcucucuuaacu

SEQ ID NO: 3578 - RNA, 19 nt, Artificial Sequence
  Description of Artificial Sequence: Synthetic oligonucleotide
aguuaagagagccaacagu

SEQ ID NO: 3579 - RNA, 19 nt, Artificial Sequence
  Description of Artificial Sequence: Synthetic oligonucleotide
ggcucucuuaacugugucc

SEQ ID NO: 3580 - RNA, 19 nt, Artificial Sequence
  Description of Artificial Sequence: Synthetic oligonucleotide
ggacacaguuaagagagcc

SEQ ID NO: 3581 - RNA, 19 nt, Artificial Sequence
  Description of Artificial Sequence: Synthetic oligonucleotide
gcucucuuaacugugucca

SEQ ID NO: 3582 - RNA, 19 nt, Artificial Sequence
  Description of Artificial Sequence: Synthetic oligonucleotide
uggacacaguuaagagagc

SEQ ID NO: 3583 - RNA, 19 nt, Artificial Sequence
  Description of Artificial Sequence: Synthetic oligonucleotide
uaacuguguccacuccuuc

SEQ ID NO: 3584 - RNA, 19 nt, Artificial Sequence
  Description of Artificial Sequence: Synthetic oligonucleotide
gaaggaguggacacaguua

SEQ ID NO: 3585 - RNA, 19 nt, Artificial Sequence
  Description of Artificial Sequence: Synthetic oligonucleotide
aacuguguccacuccuuca

SEQ ID NO: 3586 - RNA, 19 nt, Artificial Sequence
  Description of Artificial Sequence: Synthetic oligonucleotide
ugaaggaguggacacaguu

SEQ ID NO: 3587 - RNA, 19 nt, Artificial Sequence
  Description of Artificial Sequence: Synthetic oligonucleotide
acuguguccacuccuucau

SEQ ID NO: 3588 - RNA, 19 nt, Artificial Sequence
  Description of Artificial Sequence: Synthetic oligonucleotide
augaaggaguggacacagu

SEQ ID NO: 3589 - RNA, 19 nt, Artificial Sequence
  Description of Artificial Sequence: Synthetic oligonucleotide
uguguccacuccuucaugg

SEQ ID NO: 3590 - RNA, 19 nt, Artificial Sequence
  Description of Artificial Sequence: Synthetic oligonucleotide
ccaugaaggaguggacaca

SEQ ID NO: 3591 - RNA, 19 nt, Artificial Sequence
  Description of Artificial Sequence: Synthetic oligonucleotide
guguccacuccuucauggu

SEQ ID NO: 3592 - RNA, 19 nt, Artificial Sequence
  Description of Artificial Sequence: Synthetic oligonucleotide
accaugaaggaguggacac

SEQ ID NO: 3593 - RNA, 19 nt, Artificial Sequence
  Description of Artificial Sequence: Synthetic oligonucleotide
uguccacuccuucauggug

SEQ ID NO: 3594 - RNA, 19 nt, Artificial Sequence
  Description of Artificial Sequence: Synthetic oligonucleotide
caccaugaaggaguggaca

SEQ ID NO: 3595 - RNA, 19 nt, Artificial Sequence
  Description of Artificial Sequence: Synthetic oligonucleotide
guccacuccuucauggugu

SEQ ID NO: 3596 - RNA, 19 nt, Artificial Sequence
  Description of Artificial Sequence: Synthetic oligonucleotide
acaccaugaaggaguggac

SEQ ID NO: 3597 - RNA, 19 nt, Artificial Sequence
  Description of Artificial Sequence: Synthetic oligonucleotide
uccacuccuucaugguguc

SEQ ID NO: 3598 - RNA, 19 nt, Artificial Sequence
  Description of Artificial Sequence: Synthetic oligonucleotide
gacaccaugaaggagugga

SEQ ID NO: 3599 - RNA, 19 nt, Artificial Sequence
  Description of Artificial Sequence: Synthetic oligonucleotide
ccacuccuucaugguguca

SEQ ID NO: 3600 - RNA, 19 nt, Artificial Sequence
  Description of Artificial Sequence: Synthetic oligonucleotide
ugacaccaugaaggagugg

SEQ ID NO: 3601 - RNA, 19 nt, Artificial Sequence
  Description of Artificial Sequence: Synthetic oligonucleotide
cacuccuucauggugucag

SEQ ID NO: 3602 - RNA, 19 nt, Artificial Sequence
  Description of Artificial Sequence: Synthetic oligonucleotide
cugacaccaugaaggagug

SEQ ID NO: 3603 - RNA, 19 nt, Artificial Sequence
  Description of Artificial Sequence: Synthetic oligonucleotide
acuccuucauggugucaga

SEQ ID NO: 3604 - RNA, 19 nt, Artificial Sequence
  Description of Artificial Sequence: Synthetic oligonucleotide
ucugacaccaugaaggagu

SEQ ID NO: 3605 - RNA, 19 nt, Artificial Sequence
  Description of Artificial Sequence: Synthetic oligonucleotide
agcacugaagcaucuccaa

SEQ ID NO: 3606 - RNA, 19 nt, Artificial Sequence
  Description of Artificial Sequence: Synthetic oligonucleotide
uuggagaugcuucagugcu

SEQ ID NO: 3607 - RNA, 19 nt, Artificial Sequence
  Description of Artificial Sequence: Synthetic oligonucleotide
gcacugaagcaucuccaaa

SEQ ID NO: 3608 - RNA, 19 nt, Artificial Sequence
  Description of Artificial Sequence: Synthetic oligonucleotide
uuuggagaugcuucagugc

SEQ ID NO: 3609 - RNA, 19 nt, Artificial Sequence
  Description of Artificial Sequence: Synthetic oligonucleotide
cacugaagcaucuccaaaa

SEQ ID NO: 3610 - RNA, 19 nt, Artificial Sequence
  Description of Artificial Sequence: Synthetic oligonucleotide
uuuuggagaugcuucagug

SEQ ID NO: 3611 - RNA, 19 nt, Artificial Sequence
  Description of Artificial Sequence: Synthetic oligonucleotide
aacguagugaugggacacc

SEQ ID NO: 3612 - RNA, 19 nt, Artificial Sequence
  Description of Artificial Sequence: Synthetic oligonucleotide
ggugucccaucacuacguu

SEQ ID NO: 3613 - RNA, 19 nt, Artificial Sequence
  Description of Artificial Sequence: Synthetic oligonucleotide
acguagugaugggacacca

SEQ ID NO: 3614 - RNA, 19 nt, Artificial Sequence
  Description of Artificial Sequence: Synthetic oligonucleotide
uggugucccaucacuacgu

SEQ ID NO: 3615 - RNA, 19 nt, Artificial Sequence
  Description of Artificial Sequence: Synthetic oligonucleotide
ggacaccauuuccuuggaa

SEQ ID NO: 3616 - RNA, 19 nt, Artificial Sequence
  Description of Artificial Sequence: Synthetic oligonucleotide
uuccaaggaaauggugucc

SEQ ID NO: 3617 - RNA, 19 nt, Artificial Sequence
  Description of Artificial Sequence: Synthetic oligonucleotide
gacaccauuuccuuggaau

SEQ ID NO: 3618 - RNA, 19 nt, Artificial Sequence
  Description of Artificial Sequence: Synthetic oligonucleotide
auuccaaggaaaugguguc

SEQ ID NO: 3619 - RNA, 19 nt, Artificial Sequence
  Description of Artificial Sequence: Synthetic oligonucleotide
acaccauuuccuuggaaua

SEQ ID NO: 3620 - RNA, 19 nt, Artificial Sequence
  Description of Artificial Sequence: Synthetic oligonucleotide
uauuccaaggaaauggugu

SEQ ID NO: 3621 - RNA, 19 nt, Artificial Sequence
  Description of Artificial Sequence: Synthetic oligonucleotide
caccauuuccuuggaauaa

SEQ ID NO: 3622 - RNA, 19 nt, Artificial Sequence
  Description of Artificial Sequence: Synthetic oligonucleotide
uuauuccaaggaaauggug

SEQ ID NO: 3623 - RNA, 19 nt, Artificial Sequence
  Description of Artificial Sequence: Synthetic oligonucleotide
ccauuuccuuggaauaaaa

SEQ ID NO: 3624 - RNA, 19 nt, Artificial Sequence
  Description of Artificial Sequence: Synthetic oligonucleotide
uuuuauuccaaggaaaugg

SEQ ID NO: 3625 - RNA, 19 nt, Artificial Sequence
  Description of Artificial Sequence: Synthetic oligonucleotide
uuccuuggaauaaaauacg

SEQ ID NO: 3626 - RNA, 19 nt, Artificial Sequence
  Description of Artificial Sequence: Synthetic oligonucleotide
cguauuuuauuccaaggaa

SEQ ID NO: 3627 - RNA, 19 nt, Artificial Sequence
  Description of Artificial Sequence: Synthetic oligonucleotide
uccuuggaauaaaauacga

SEQ ID NO: 3628 - RNA, 19 nt, Artificial Sequence
  Description of Artificial Sequence: Synthetic oligonucleotide
ucguauuuuauuccaagga

SEQ ID NO: 3629 - RNA, 19 nt, Artificial Sequence
  Description of Artificial Sequence: Synthetic oligonucleotide
ccuuggaauaaaauacgac

SEQ ID NO: 3630 - RNA, 19 nt, Artificial Sequence
  Description of Artificial Sequence: Synthetic oligonucleotide
gucguauuuuauuccaagg

SEQ ID NO: 3631 - RNA, 19 nt, Artificial Sequence
  Description of Artificial Sequence: Synthetic oligonucleotide
uggaauaaaauacgacuuc

SEQ ID NO: 3632 - RNA, 19 nt, Artificial Sequence
  Description of Artificial Sequence: Synthetic oligonucleotide
gaagucguauuuuauucca

SEQ ID NO: 3633 - RNA, 19 nt, Artificial Sequence
  Description of Artificial Sequence: Synthetic oligonucleotide
gaauaaaauacgacuuccu

SEQ ID NO: 3634 - RNA, 19 nt, Artificial Sequence
  Description of Artificial Sequence: Synthetic oligonucleotide
aggaagucguauuuuauuc

SEQ ID NO: 3635 - RNA, 19 nt, Artificial Sequence
  Description of Artificial Sequence: Synthetic oligonucleotide
gucaucccaguucauuaug

SEQ ID NO: 3636 - RNA, 19 nt, Artificial Sequence
  Description of Artificial Sequence: Synthetic oligonucleotide
cauaaugaacugggaugac

SEQ ID NO: 3637 - RNA, 19 nt, Artificial Sequence
  Description of Artificial Sequence: Synthetic oligonucleotide
cccaguucauuaugaucuc

SEQ ID NO: 3638 - RNA, 19 nt, Artificial Sequence
  Description of Artificial Sequence: Synthetic oligonucleotide
gagaucauaaugaacuggg

SEQ ID NO: 3639 - RNA, 19 nt, Artificial Sequence
  Description of Artificial Sequence: Synthetic oligonucleotide
ccaguucauuaugaucucu

SEQ ID NO: 3640 - RNA, 19 nt, Artificial Sequence
  Description of Artificial Sequence: Synthetic oligonucleotide
agagaucauaaugaacugg

SEQ ID NO: 3641 - RNA, 19 nt, Artificial Sequence
  Description of Artificial Sequence: Synthetic oligonucleotide
caguucauuaugaucucuu

SEQ ID NO: 3642 - RNA, 19 nt, Artificial Sequence
  Description of Artificial Sequence: Synthetic oligonucleotide
aagagaucauaaugaacug

SEQ ID NO: 3643 - RNA, 19 nt, Artificial Sequence
  Description of Artificial Sequence: Synthetic oligonucleotide
uaccacgcugaccuucugg

SEQ ID NO: 3644 - RNA, 19 nt, Artificial Sequence
  Description of Artificial Sequence: Synthetic oligonucleotide
ccagaaggucagcguggua

SEQ ID NO: 3645 - RNA, 19 nt, Artificial Sequence
  Description of Artificial Sequence: Synthetic oligonucleotide
accacgcugaccuucuggg

SEQ ID NO: 3646 - RNA, 19 nt, Artificial Sequence
  Description of Artificial Sequence: Synthetic oligonucleotide
cccagaaggucagcguggu

SEQ ID NO: 3647 - RNA, 19 nt, Artificial Sequence
  Description of Artificial Sequence: Synthetic oligonucleotide
aaucacagccagucagccc

SEQ ID NO: 3648 - RNA, 19 nt, Artificial Sequence
  Description of Artificial Sequence: Synthetic oligonucleotide
gggcugacuggcugugauu

SEQ ID NO: 3649 - RNA, 19 nt, Artificial Sequence
  Description of Artificial Sequence: Synthetic oligonucleotide
aucacagccagucagccca

SEQ ID NO: 3650 - RNA, 19 nt, Artificial Sequence
  Description of Artificial Sequence: Synthetic oligonucleotide
ugggcugacuggcugugau

SEQ ID NO: 3651 - RNA, 19 nt, Artificial Sequence
  Description of Artificial Sequence: Synthetic oligonucleotide
caccagcaccaucauccug

SEQ ID NO: 3652 - RNA, 19 nt, Artificial Sequence
  Description of Artificial Sequence: Synthetic oligonucleotide
caggaugauggugcuggug

SEQ ID NO: 3653 - RNA, 19 nt, Artificial Sequence
  Description of Artificial Sequence: Synthetic oligonucleotide
accagcaccaucauccugc

SEQ ID NO: 3654 - RNA, 19 nt, Artificial Sequence
  Description of Artificial Sequence: Synthetic oligonucleotide
gcaggaugauggugcuggu

SEQ ID NO: 3655 - RNA, 19 nt, Artificial Sequence
  Description of Artificial Sequence: Synthetic oligonucleotide
ccagcaccaucauccugca

SEQ ID NO: 3656 - RNA, 19 nt, Artificial Sequence
  Description of Artificial Sequence: Synthetic oligonucleotide
ugcaggaugauggugcugg

SEQ ID NO: 3657 - RNA, 19 nt, Artificial Sequence
  Description of Artificial Sequence: Synthetic oligonucleotide
cagcaccaucauccugcau

SEQ ID NO: 3658 - RNA, 19 nt, Artificial Sequence
  Description of Artificial Sequence: Synthetic oligonucleotide
augcaggaugauggugcug

SEQ ID NO: 3659 - RNA, 19 nt, Artificial Sequence
  Description of Artificial Sequence: Synthetic oligonucleotide
agcaccaucauccugcaua

SEQ ID NO: 3660 - RNA, 19 nt, Artificial Sequence
  Description of Artificial Sequence: Synthetic oligonucleotide
uaugcaggaugauggugcu

SEQ ID NO: 3661 - RNA, 19 nt, Artificial Sequence
  Description of Artificial Sequence: Synthetic oligonucleotide
gcaccaucauccugcauag

SEQ ID NO: 3662 - RNA, 19 nt, Artificial Sequence
  Description of Artificial Sequence: Synthetic oligonucleotide
cuaugcaggaugauggugc

SEQ ID NO: 3663 - RNA, 19 nt, Artificial Sequence
  Description of Artificial Sequence: Synthetic oligonucleotide
caccaucauccugcauagu

SEQ ID NO: 3664 - RNA, 19 nt, Artificial Sequence
  Description of Artificial Sequence: Synthetic oligonucleotide
acuaugcaggaugauggug

SEQ ID NO: 3665 - RNA, 19 nt, Artificial Sequence
  Description of Artificial Sequence: Synthetic oligonucleotide
accaucauccugcauaguc

SEQ ID NO: 3666 - RNA, 19 nt, Artificial Sequence
  Description of Artificial Sequence: Synthetic oligonucleotide
gacuaugcaggaugauggu

SEQ ID NO: 3667 - RNA, 19 nt, Artificial Sequence
  Description of Artificial Sequence: Synthetic oligonucleotide
ccaucauccugcauaguca

SEQ ID NO: 3668 - RNA, 19 nt, Artificial Sequence
  Description of Artificial Sequence: Synthetic oligonucleotide
ugacuaugcaggaugaugg

SEQ ID NO: 3669 - RNA, 19 nt, Artificial Sequence
  Description of Artificial Sequence: Synthetic oligonucleotide
cauccugcauagucaccac

SEQ ID NO: 3670 - RNA, 19 nt, Artificial Sequence
  Description of Artificial Sequence: Synthetic oligonucleotide
guggugacuaugcaggaug

SEQ ID NO: 3671 - RNA, 19 nt, Artificial Sequence
  Description of Artificial Sequence: Synthetic oligonucleotide
uagucaccaccugcagaua

SEQ ID NO: 3672 - RNA, 19 nt, Artificial Sequence
  Description of Artificial Sequence: Synthetic oligonucleotide
uaucugcagguggugacua

SEQ ID NO: 3673 - RNA, 19 nt, Artificial Sequence
  Description of Artificial Sequence: Synthetic oligonucleotide
agucaccaccugcagauau

SEQ ID NO: 3674 - RNA, 19 nt, Artificial Sequence
  Description of Artificial Sequence: Synthetic oligonucleotide
auaucugcagguggugacu

SEQ ID NO: 3675 - RNA, 19 nt, Artificial Sequence
  Description of Artificial Sequence: Synthetic oligonucleotide
accaccugcagauaucuag

SEQ ID NO: 3676 - RNA, 19 nt, Artificial Sequence
  Description of Artificial Sequence: Synthetic oligonucleotide
cuagauaucugcagguggu

SEQ ID NO: 3677 - RNA, 19 nt, Artificial Sequence
  Description of Artificial Sequence: Synthetic oligonucleotide
ccaccugcagauaucuagg

SEQ ID NO: 3678 - RNA, 19 nt, Artificial Sequence
  Description of Artificial Sequence: Synthetic oligonucleotide
ccuagauaucugcaggugg

SEQ ID NO: 3679 - RNA, 19 nt, Artificial Sequence
  Description of Artificial Sequence: Synthetic oligonucleotide
caccugcagauaucuaggg

SEQ ID NO: 3680 - RNA, 19 nt, Artificial Sequence
  Description of Artificial Sequence: Synthetic oligonucleotide
cccuagauaucugcaggug

SEQ ID NO: 3681 - RNA, 19 nt, Artificial Sequence
  Description of Artificial Sequence: Synthetic oligonucleotide
accugcagauaucuagggc

SEQ ID NO: 3682 - RNA, 19 nt, Artificial Sequence
  Description of Artificial Sequence: Synthetic oligonucleotide
gcccuagauaucugcaggu

SEQ ID NO: 3683 - RNA, 19 nt, Artificial Sequence
  Description of Artificial Sequence: Synthetic oligonucleotide
ccugcagauaucuagggcc

SEQ ID NO: 3684 - RNA, 19 nt, Artificial Sequence
  Description of Artificial Sequence: Synthetic oligonucleotide
ggcccuagauaucugcagg

SEQ ID NO: 3685 - RNA, 19 nt, Artificial Sequence
  Description of Artificial Sequence: Synthetic oligonucleotide
caaauugcacugcuggcuc

SEQ ID NO: 3686 - RNA, 19 nt, Artificial Sequence
  Description of Artificial Sequence: Synthetic oligonucleotide
gagccagcagugcaauuug

SEQ ID NO: 3687 - RNA, 19 nt, Artificial Sequence
  Description of Artificial Sequence: Synthetic oligonucleotide
uccuugucgggcucccgua

SEQ ID NO: 3688 - RNA, 19 nt, Artificial Sequence
  Description of Artificial Sequence: Synthetic oligonucleotide
uacgggagcccgacaagga

SEQ ID NO: 3689 - RNA, 19 nt, Artificial Sequence
  Description of Artificial Sequence: Synthetic oligonucleotide
cuugucgggcucccguaca

SEQ ID NO: 3690 - RNA, 19 nt, Artificial Sequence
  Description of Artificial Sequence: Synthetic oligonucleotide
uguacgggagcccgacaag

SEQ ID NO: 3691 - RNA, 19 nt, Artificial Sequence
  Description of Artificial Sequence: Synthetic oligonucleotide
cacaguugucauucacuau

SEQ ID NO: 3692 - RNA, 19 nt, Artificial Sequence
  Description of Artificial Sequence: Synthetic oligonucleotide
auagugaaugacaacugug

SEQ ID NO: 3693 - RNA, 19 nt, Artificial Sequence
  Description of Artificial Sequence: Synthetic oligonucleotide
acaguugucauucacuaug

SEQ ID NO: 3694 - RNA, 19 nt, Artificial Sequence
  Description of Artificial Sequence: Synthetic oligonucleotide
cauagugaaugacaacugu

SEQ ID NO: 3695 - RNA, 19 nt, Artificial Sequence
  Description of Artificial Sequence: Synthetic oligonucleotide
caguugucauucacuaugc

SEQ ID NO: 3696 - RNA, 19 nt, Artificial Sequence
  Description of Artificial Sequence: Synthetic oligonucleotide
gcauagugaaugacaacug

SEQ ID NO: 3697 - RNA, 19 nt, Artificial Sequence
  Description of Artificial Sequence: Synthetic oligonucleotide
aguugucauucacuaugcu

SEQ ID NO: 3698 - RNA, 19 nt, Artificial Sequence
  Description of Artificial Sequence: Synthetic oligonucleotide
agcauagugaaugacaacu

SEQ ID NO: 3699 - RNA, 19 nt, Artificial Sequence
  Description of Artificial Sequence: Synthetic oligonucleotide
guugucauucacuaugcug

SEQ ID NO: 3700 - RNA, 19 nt, Artificial Sequence
  Description of Artificial Sequence: Synthetic oligonucleotide
cagcauagugaaugacaac

SEQ ID NO: 3701 - RNA, 19 nt, Artificial Sequence
  Description of Artificial Sequence: Synthetic oligonucleotide
cauucacuaugcuggcaau

SEQ ID NO: 3702 - RNA, 19 nt, Artificial Sequence
  Description of Artificial Sequence: Synthetic oligonucleotide
auugccagcauagugaaug

SEQ ID NO: 3703 - RNA, 19 nt, Artificial Sequence
  Description of Artificial Sequence: Synthetic oligonucleotide
auucacuaugcuggcaauc

SEQ ID NO: 3704 - RNA, 19 nt, Artificial Sequence
  Description of Artificial Sequence: Synthetic oligonucleotide
gauugccagcauagugaau

SEQ ID NO: 3705 - RNA, 19 nt, Artificial Sequence
  Description of Artificial Sequence: Synthetic oligonucleotide
uucacuaugcuggcaaucu

SEQ ID NO: 3706 - RNA, 19 nt, Artificial Sequence
  Description of Artificial Sequence: Synthetic oligonucleotide
agauugccagcauagugaa

SEQ ID NO: 3707 - RNA, 19 nt, Artificial Sequence
  Description of Artificial Sequence: Synthetic oligonucleotide
ucacuaugcuggcaaucuu

SEQ ID NO: 3708 - RNA, 19 nt, Artificial Sequence
  Description of Artificial Sequence: Synthetic oligonucleotide
aagauugccagcauaguga

SEQ ID NO: 3709 - RNA, 19 nt, Artificial Sequence
  Description of Artificial Sequence: Synthetic oligonucleotide
cacuaugcuggcaaucuuu

SEQ ID NO: 3710 - RNA, 19 nt, Artificial Sequence
  Description of Artificial Sequence: Synthetic oligonucleotide
aaagauugccagcauagug

SEQ ID NO: 3711 - RNA, 19 nt, Artificial Sequence
  Description of Artificial Sequence: Synthetic oligonucleotide
acuaugcuggcaaucuuuc

SEQ ID NO: 3712 - RNA, 19 nt, Artificial Sequence
  Description of Artificial Sequence: Synthetic oligonucleotide
gaaagauugccagcauagu

SEQ ID NO: 3713 - RNA, 19 nt, Artificial Sequence
  Description of Artificial Sequence: Synthetic oligonucleotide
agacuuuccacggauuuua

SEQ ID NO: 3714 - RNA, 19 nt, Artificial Sequence
  Description of Artificial Sequence: Synthetic oligonucleotide
uaaaauccguggaaagucu

SEQ ID NO: 3715 - RNA, 19 nt, Artificial Sequence
  Description of Artificial Sequence: Synthetic oligonucleotide
gacuuuccacggauuuuac

SEQ ID NO: 3716 - RNA, 19 nt, Artificial Sequence
  Description of Artificial Sequence: Synthetic oligonucleotide
guaaaauccguggaaaguc

SEQ ID NO: 3717 - RNA, 19 nt, Artificial Sequence
  Description of Artificial Sequence: Synthetic oligonucleotide
acuuuccacggauuuuaca

SEQ ID NO: 3718 - RNA, 19 nt, Artificial Sequence
  Description of Artificial Sequence: Synthetic oligonucleotide
uguaaaauccguggaaagu

SEQ ID NO: 3719 - RNA, 19 nt, Artificial Sequence
  Description of Artificial Sequence: Synthetic oligonucleotide
aacugaggauacuagcauc

SEQ ID NO: 3720 - RNA, 19 nt, Artificial Sequence
  Description of Artificial Sequence: Synthetic oligonucleotide
gaugcuaguauccucaguu

SEQ ID NO: 3721 - RNA, 19 nt, Artificial Sequence
  Description of Artificial Sequence: Synthetic oligonucleotide
acugaggauacuagcauca

SEQ ID NO: 3722 - RNA, 19 nt, Artificial Sequence
  Description of Artificial Sequence: Synthetic oligonucleotide
ugaugcuaguauccucagu

SEQ ID NO: 3723 - RNA, 19 nt, Artificial Sequence
  Description of Artificial Sequence: Synthetic oligonucleotide
cugaggauacuagcaucaa

SEQ ID NO: 3724 - RNA, 19 nt, Artificial Sequence
  Description of Artificial Sequence: Synthetic oligonucleotide
uugaugcuaguauccucag

SEQ ID NO: 3725 - RNA, 19 nt, Artificial Sequence
  Description of Artificial Sequence: Synthetic oligonucleotide
ugaggauacuagcaucaac

SEQ ID NO: 3726 - RNA, 19 nt, Artificial Sequence
  Description of Artificial Sequence: Synthetic oligonucleotide
guugaugcuaguauccuca

SEQ ID NO: 3727 - RNA, 19 nt, Artificial Sequence
  Description of Artificial Sequence: Synthetic oligonucleotide
ugcagcuagaauggccuuu

SEQ ID NO: 3728 - RNA, 19 nt, Artificial Sequence
  Description of Artificial Sequence: Synthetic oligonucleotide
aaaggccauucuagcugca

SEQ ID NO: 3729 - RNA, 19 nt, Artificial Sequence
  Description of Artificial Sequence: Synthetic oligonucleotide
aauggccuuucccugcuuu

SEQ ID NO: 3730 - RNA, 19 nt, Artificial Sequence
  Description of Artificial Sequence: Synthetic oligonucleotide
aaagcagggaaaggccauu

SEQ ID NO: 3731 - RNA, 19 nt, Artificial Sequence
  Description of Artificial Sequence: Synthetic oligonucleotide
gccuuucccugcuuugaug

SEQ ID NO: 3732 - RNA, 19 nt, Artificial Sequence
  Description of Artificial Sequence: Synthetic oligonucleotide
caucaaagcagggaaaggc

SEQ ID NO: 3733 - RNA, 19 nt, Artificial Sequence
  Description of Artificial Sequence: Synthetic oligonucleotide
cuuucccugcuuugaugaa

SEQ ID NO: 3734 - RNA, 19 nt, Artificial Sequence
  Description of Artificial Sequence: Synthetic oligonucleotide
uucaucaaagcagggaaag

SEQ ID NO: 3735 - RNA, 19 nt, Artificial Sequence
  Description of Artificial Sequence: Synthetic oligonucleotide
accugccuucaaagcaagu

SEQ ID NO: 3736 - RNA, 19 nt, Artificial Sequence
  Description of Artificial Sequence: Synthetic oligonucleotide
acuugcuuugaaggcaggu

SEQ ID NO: 3737 - RNA, 19 nt, Artificial Sequence
  Description of Artificial Sequence: Synthetic oligonucleotide
cugccuucaaagcaaguuu

SEQ ID NO: 3738 - RNA, 19 nt, Artificial Sequence
  Description of Artificial Sequence: Synthetic oligonucleotide
aaacuugcuuugaaggcag

SEQ ID NO: 3739 - RNA, 19 nt, Artificial Sequence
  Description of Artificial Sequence: Synthetic oligonucleotide
ugccuucaaagcaaguuuc

SEQ ID NO: 3740 - RNA, 19 nt, Artificial Sequence
  Description of Artificial Sequence: Synthetic oligonucleotide
gaaacuugcuuugaaggca

SEQ ID NO: 3741 - RNA, 19 nt, Artificial Sequence
  Description of Artificial Sequence: Synthetic oligonucleotide
gccuucaaagcaaguuucu

SEQ ID NO: 3742 - RNA, 19 nt, Artificial Sequence
  Description of Artificial Sequence: Synthetic oligonucleotide
agaaacuugcuuugaaggc

SEQ ID NO: 3743 - RNA, 19 nt, Artificial Sequence
  Description of Artificial Sequence: Synthetic oligonucleotide
caaagcaaguuucucaauc

SEQ ID NO: 3744 - RNA, 19 nt, Artificial Sequence
  Description of Artificial Sequence: Synthetic oligonucleotide
gauugagaaacuugcuuug

SEQ ID NO: 3745 - RNA, 19 nt, Artificial Sequence
  Description of Artificial Sequence: Synthetic oligonucleotide
aagcaaguuucucaaucaa

SEQ ID NO: 3746 - RNA, 19 nt, Artificial Sequence
  Description of Artificial Sequence: Synthetic oligonucleotide
uugauugagaaacuugcuu

SEQ ID NO: 3747 - RNA, 19 nt, Artificial Sequence
  Description of Artificial Sequence: Synthetic oligonucleotide
agcaaguuucucaaucaaa

SEQ ID NO: 3748 - RNA, 19 nt, Artificial Sequence
  Description of Artificial Sequence: Synthetic oligonucleotide
uuugauugagaaacuugcu

SEQ ID NO: 3749 - RNA, 19 nt, Artificial Sequence
  Description of Artificial Sequence: Synthetic oligonucleotide
gcaaguuucucaaucaaaa

SEQ ID NO: 3750 - RNA, 19 nt, Artificial Sequence
  Description of Artificial Sequence: Synthetic oligonucleotide
uuuugauugagaaacuugc

SEQ ID NO: 3751 - RNA, 19 nt, Artificial Sequence
  Description of Artificial Sequence: Synthetic oligonucleotide
gagccaaggcaccuagcca

SEQ ID NO: 3752 - RNA, 19 nt, Artificial Sequence
  Description of Artificial Sequence: Synthetic oligonucleotide
uggcuaggugccuuggcuc

SEQ ID NO: 3753 - RNA, 19 nt, Artificial Sequence
  Description of Artificial Sequence: Synthetic oligonucleotide
ggcaccuagccaucuccaa

SEQ ID NO: 3754 - RNA, 19 nt, Artificial Sequence
  Description of Artificial Sequence: Synthetic oligonucleotide
uuggagauggcuaggugcc

SEQ ID NO: 3755 - RNA, 19 nt, Artificial Sequence
  Description of Artificial Sequence: Synthetic oligonucleotide
gcaccuagccaucuccaau

SEQ ID NO: 3756 - RNA, 19 nt, Artificial Sequence
  Description of Artificial Sequence: Synthetic oligonucleotide
auuggagauggcuaggugc

SEQ ID NO: 3757 - RNA, 19 nt, Artificial Sequence
  Description of Artificial Sequence: Synthetic oligonucleotide
caccuagccaucuccaaua

SEQ ID NO: 3758 - RNA, 19 nt, Artificial Sequence
  Description of Artificial Sequence: Synthetic oligonucleotide
uauuggagauggcuaggug

SEQ ID NO: 3759 - RNA, 19 nt, Artificial Sequence
  Description of Artificial Sequence: Synthetic oligonucleotide
accuagccaucuccaauau

SEQ ID NO: 3760 - RNA, 19 nt, Artificial Sequence
  Description of Artificial Sequence: Synthetic oligonucleotide
auauuggagauggcuaggu

SEQ ID NO: 3761 - RNA, 19 nt, Artificial Sequence
  Description of Artificial Sequence: Synthetic oligonucleotide
ccuagccaucuccaauaug

SEQ ID NO: 3762 - RNA, 19 nt, Artificial Sequence
  Description of Artificial Sequence: Synthetic oligonucleotide
cauauuggagauggcuagg

SEQ ID NO: 3763 - RNA, 19 nt, Artificial Sequence
  Description of Artificial Sequence: Synthetic oligonucleotide
cuagccaucuccaauaugc

SEQ ID NO: 3764 - RNA, 19 nt, Artificial Sequence
  Description of Artificial Sequence: Synthetic oligonucleotide
gcauauuggagauggcuag

SEQ ID NO: 3765 - RNA, 19 nt, Artificial Sequence
  Description of Artificial Sequence: Synthetic oligonucleotide
uagccaucuccaauaugcc

SEQ ID NO: 3766 - RNA, 19 nt, Artificial Sequence
  Description of Artificial Sequence: Synthetic oligonucleotide
ggcauauuggagauggcua

SEQ ID NO: 3767 - RNA, 19 nt, Artificial Sequence
  Description of Artificial Sequence: Synthetic oligonucleotide
agccaucuccaauaugcca

SEQ ID NO: 3768 - RNA, 19 nt, Artificial Sequence
  Description of Artificial Sequence: Synthetic oligonucleotide
uggcauauuggagauggcu

SEQ ID NO: 3769 - RNA, 19 nt, Artificial Sequence
  Description of Artificial Sequence: Synthetic oligonucleotide
aaaucugugacuguugcug

SEQ ID NO: 3770 - RNA, 19 nt, Artificial Sequence
  Description of Artificial Sequence: Synthetic oligonucleotide
cagcaacagucacagauuu

SEQ ID NO: 3771 - RNA, 19 nt, Artificial Sequence
  Description of Artificial Sequence: Synthetic oligonucleotide
aaucugugacuguugcuga

SEQ ID NO: 3772 - RNA, 19 nt, Artificial Sequence
  Description of Artificial Sequence: Synthetic oligonucleotide
ucagcaacagucacagauu

SEQ ID NO: 3773 - RNA, 19 nt, Artificial Sequence
  Description of Artificial Sequence: Synthetic oligonucleotide
aucugugacuguugcugaa

SEQ ID NO: 3774 - RNA, 19 nt, Artificial Sequence
  Description of Artificial Sequence: Synthetic oligonucleotide
uucagcaacagucacagau

SEQ ID NO: 3775 - RNA, 19 nt, Artificial Sequence
  Description of Artificial Sequence: Synthetic oligonucleotide
ucugugacuguugcugaag

SEQ ID NO: 3776 - RNA, 19 nt, Artificial Sequence
  Description of Artificial Sequence: Synthetic oligonucleotide
cuucagcaacagucacaga

SEQ ID NO: 3777 - RNA, 19 nt, Artificial Sequence
  Description of Artificial Sequence: Synthetic oligonucleotide
ugacuguugcugaaggacu

SEQ ID NO: 3778 - RNA, 19 nt, Artificial Sequence
  Description of Artificial Sequence: Synthetic oligonucleotide
aguccuucagcaacaguca

SEQ ID NO: 3779 - RNA, 19 nt, Artificial Sequence
  Description of Artificial Sequence: Synthetic oligonucleotide
acuguugcugaaggacuca

SEQ ID NO: 3780 - RNA, 19 nt, Artificial Sequence
  Description of Artificial Sequence: Synthetic oligonucleotide
ugaguccuucagcaacagu

SEQ ID NO: 3781 - RNA, 19 nt, Artificial Sequence
  Description of Artificial Sequence: Synthetic oligonucleotide
cuguugcugaaggacucau

SEQ ID NO: 3782 - RNA, 19 nt, Artificial Sequence
  Description of Artificial Sequence: Synthetic oligonucleotide
augaguccuucagcaacag

SEQ ID NO: 3783 - RNA, 19 nt, Artificial Sequence
  Description of Artificial Sequence: Synthetic oligonucleotide
uguugcugaaggacucaua

SEQ ID NO: 3784 - RNA, 19 nt, Artificial Sequence
  Description of Artificial Sequence: Synthetic oligonucleotide
uaugaguccuucagcaaca

SEQ ID NO: 3785 - RNA, 19 nt, Artificial Sequence
  Description of Artificial Sequence: Synthetic oligonucleotide
guugcugaaggacucauag

SEQ ID NO: 3786 - RNA, 19 nt, Artificial Sequence
  Description of Artificial Sequence: Synthetic oligonucleotide
cuaugaguccuucagcaac

SEQ ID NO: 3787 - RNA, 19 nt, Artificial Sequence
  Description of Artificial Sequence: Synthetic oligonucleotide
uugcugaaggacucauaga

SEQ ID NO: 3788 - RNA, 19 nt, Artificial Sequence
  Description of Artificial Sequence: Synthetic oligonucleotide
ucuaugaguccuucagcaa

SEQ ID NO: 3789 - RNA, 19 nt, Artificial Sequence
  Description of Artificial Sequence: Synthetic oligonucleotide
ugcugaaggacucauagaa

SEQ ID NO: 3790 - RNA, 19 nt, Artificial Sequence
  Description of Artificial Sequence: Synthetic oligonucleotide
uucuaugaguccuucagca

SEQ ID NO: 3791 - RNA, 19 nt, Artificial Sequence
  Description of Artificial Sequence: Synthetic oligonucleotide
gcugaaggacucauagaag

SEQ ID NO: 3792 - RNA, 19 nt, Artificial Sequence
  Description of Artificial Sequence: Synthetic oligonucleotide
cuucuaugaguccuucagc

SEQ ID NO: 3793 - RNA, 19 nt, Artificial Sequence
  Description of Artificial Sequence: Synthetic oligonucleotide
cugaaggacucauagaaga

SEQ ID NO: 3794 - RNA, 19 nt, Artificial Sequence
  Description of Artificial Sequence: Synthetic oligonucleotide
ucuucuaugaguccuucag

SEQ ID NO: 3795 - RNA, 19 nt, Artificial Sequence
  Description of Artificial Sequence: Synthetic oligonucleotide
ugaaggacucauagaagac

SEQ ID NO: 3796 - RNA, 19 nt, Artificial Sequence
  Description of Artificial Sequence: Synthetic oligonucleotide
gucuucuaugaguccuuca

SEQ ID NO: 3797 - RNA, 19 nt, Artificial Sequence
  Description of Artificial Sequence: Synthetic oligonucleotide
aaggacucauagaagacca

SEQ ID NO: 3798 - RNA, 19 nt, Artificial Sequence
  Description of Artificial Sequence: Synthetic oligonucleotide
uggucuucuaugaguccuu

SEQ ID NO: 3799 - RNA, 19 nt, Artificial Sequence
  Description of Artificial Sequence: Synthetic oligonucleotide
aggacucauagaagaccau

SEQ ID NO: 3800 - RNA, 19 nt, Artificial Sequence
  Description of Artificial Sequence: Synthetic oligonucleotide
auggucuucuaugaguccu

SEQ ID NO: 3801 - RNA, 19 nt, Artificial Sequence
  Description of Artificial Sequence: Synthetic oligonucleotide
ggacucauagaagaccauu

SEQ ID NO: 3802 - RNA, 19 nt, Artificial Sequence
  Description of Artificial Sequence: Synthetic oligonucleotide
aauggucuucuaugagucc

SEQ ID NO: 3803 - RNA, 19 nt, Artificial Sequence
  Description of Artificial Sequence: Synthetic oligonucleotide
gacucauagaagaccauuu

SEQ ID NO: 3804 - RNA, 19 nt, Artificial Sequence
  Description of Artificial Sequence: Synthetic oligonucleotide
aaauggucuucuaugaguc

SEQ ID NO: 3805 - RNA, 19 nt, Artificial Sequence
  Description of Artificial Sequence: Synthetic oligonucleotide
acucauagaagaccauuuu

SEQ ID NO: 3806 - RNA, 19 nt, Artificial Sequence
  Description of Artificial Sequence: Synthetic oligonucleotide
aaaauggucuucuaugagu

SEQ ID NO: 3807 - RNA, 19 nt, Artificial Sequence
  Description of Artificial Sequence: Synthetic oligonucleotide
cucauagaagaccauuuug

SEQ ID NO: 3808 - RNA, 19 nt, Artificial Sequence
  Description of Artificial Sequence: Synthetic oligonucleotide
caaaauggucuucuaugag

SEQ ID NO: 3809 - RNA, 19 nt, Artificial Sequence
  Description of Artificial Sequence: Synthetic oligonucleotide
ucauagaagaccauuuuga

SEQ ID NO: 3810 - RNA, 19 nt, Artificial Sequence
  Description of Artificial Sequence: Synthetic oligonucleotide
ucaaaauggucuucuauga

SEQ ID NO: 3811 - RNA, 19 nt, Artificial Sequence
  Description of Artificial Sequence: Synthetic oligonucleotide
cauagaagaccauuuugau

SEQ ID NO: 3812 - RNA, 19 nt, Artificial Sequence
  Description of Artificial Sequence: Synthetic oligonucleotide
aucaaaauggucuucuaug

SEQ ID NO: 3813 - RNA, 19 nt, Artificial Sequence
  Description of Artificial Sequence: Synthetic oligonucleotide
auagaagaccauuuugaug

SEQ ID NO: 3814 - RNA, 19 nt, Artificial Sequence
  Description of Artificial Sequence: Synthetic oligonucleotide
caucaaaauggucuucuau

SEQ ID NO: 3815 - RNA, 19 nt, Artificial Sequence
  Description of Artificial Sequence: Synthetic oligonucleotide
uagaagaccauuuugaugu

SEQ ID NO: 3816 - RNA, 19 nt, Artificial Sequence
  Description of Artificial Sequence: Synthetic oligonucleotide
acaucaaaauggucuucua

SEQ ID NO: 3817 - RNA, 19 nt, Artificial Sequence
  Description of Artificial Sequence: Synthetic oligonucleotide
agaagaccauuuugauguc

SEQ ID NO: 3818 - RNA, 19 nt, Artificial Sequence
  Description of Artificial Sequence: Synthetic oligonucleotide
gacaucaaaauggucuucu

SEQ ID NO: 3819 - RNA, 19 nt, Artificial Sequence
  Description of Artificial Sequence: Synthetic oligonucleotide
ugaugucacugugaagaug

SEQ ID NO: 3820 - RNA, 19 nt, Artificial Sequence
  Description of Artificial Sequence: Synthetic oligonucleotide
caucuucacagugacauca

SEQ ID NO: 3821 - RNA, 19 nt, Artificial Sequence
  Description of Artificial Sequence: Synthetic oligonucleotide
gaugucacugugaagauga

SEQ ID NO: 3822 - RNA, 19 nt, Artificial Sequence
  Description of Artificial Sequence: Synthetic oligonucleotide
ucaucuucacagugacauc

SEQ ID NO: 3823 - RNA, 19 nt, Artificial Sequence
  Description of Artificial Sequence: Synthetic oligonucleotide
augucacugugaagaugag

SEQ ID NO: 3824 - RNA, 19 nt, Artificial Sequence
  Description of Artificial Sequence: Synthetic oligonucleotide
cucaucuucacagugacau

SEQ ID NO: 3825 - RNA, 19 nt, Artificial Sequence
  Description of Artificial Sequence: Synthetic oligonucleotide
ugugaagaugagcaccuau

SEQ ID NO: 3826 - RNA, 19 nt, Artificial Sequence
  Description of Artificial Sequence: Synthetic oligonucleotide
auaggugcucaucuucaca

SEQ ID NO: 3827 - RNA, 19 nt, Artificial Sequence
  Description of Artificial Sequence: Synthetic oligonucleotide
gugaagaugagcaccuauc

SEQ ID NO: 3828 - RNA, 19 nt, Artificial Sequence
  Description of Artificial Sequence: Synthetic oligonucleotide
gauaggugcucaucuucac

SEQ ID NO: 3829 - RNA, 19 nt, Artificial Sequence
  Description of Artificial Sequence: Synthetic oligonucleotide
accuaucugguggccuuca

SEQ ID NO: 3830 - RNA, 19 nt, Artificial Sequence
  Description of Artificial Sequence: Synthetic oligonucleotide
ugaaggccaccagauaggu

SEQ ID NO: 3831 - RNA, 19 nt, Artificial Sequence
  Description of Artificial Sequence: Synthetic oligonucleotide
ccuaucugguggccuucau

SEQ ID NO: 3832 - RNA, 19 nt, Artificial Sequence
  Description of Artificial Sequence: Synthetic oligonucleotide
augaaggccaccagauagg

SEQ ID NO: 3833 - RNA, 19 nt, Artificial Sequence
  Description of Artificial Sequence: Synthetic oligonucleotide
cuaucugguggccuucauc

SEQ ID NO: 3834 - RNA, 19 nt, Artificial Sequence
  Description of Artificial Sequence: Synthetic oligonucleotide
gaugaaggccaccagauag

SEQ ID NO: 3835 - RNA, 19 nt, Artificial Sequence
  Description of Artificial Sequence: Synthetic oligonucleotide
uaucugguggccuucauca

SEQ ID NO: 3836 - RNA, 19 nt, Artificial Sequence
  Description of Artificial Sequence: Synthetic oligonucleotide
ugaugaaggccaccagaua

SEQ ID NO: 3837 - RNA, 19 nt, Artificial Sequence
  Description of Artificial Sequence: Synthetic oligonucleotide
aucugguggccuucaucau

SEQ ID NO: 3838 - RNA, 19 nt, Artificial Sequence
  Description of Artificial Sequence: Synthetic oligonucleotide
augaugaaggccaccagau

SEQ ID NO: 3839 - RNA, 19 nt, Artificial Sequence
  Description of Artificial Sequence: Synthetic oligonucleotide
ucugguggccuucaucauu

SEQ ID NO: 3840 - RNA, 19 nt, Artificial Sequence
  Description of Artificial Sequence: Synthetic oligonucleotide
aaugaugaaggccaccaga

SEQ ID NO: 3841 - RNA, 19 nt, Artificial Sequence
  Description of Artificial Sequence: Synthetic oligonucleotide
cugguggccuucaucauuu

SEQ ID NO: 3842 - RNA, 19 nt, Artificial Sequence
  Description of Artificial Sequence: Synthetic oligonucleotide
aaaugaugaaggccaccag

SEQ ID NO: 3843 - RNA, 19 nt, Artificial Sequence
  Description of Artificial Sequence: Synthetic oligonucleotide
ugguggccuucaucauuuc

SEQ ID NO: 3844 - RNA, 19 nt, Artificial Sequence
  Description of Artificial Sequence: Synthetic oligonucleotide
gaaaugaugaaggccacca

SEQ ID NO: 3845 - RNA, 19 nt, Artificial Sequence
  Description of Artificial Sequence: Synthetic oligonucleotide
ggccuucaucauuucagau

SEQ ID NO: 3846 - RNA, 19 nt, Artificial Sequence
  Description of Artificial Sequence: Synthetic oligonucleotide
aucugaaaugaugaaggcc

SEQ ID NO: 3847 - RNA, 19 nt, Artificial Sequence
  Description of Artificial Sequence: Synthetic oligonucleotide
gccuucaucauuucagauu

SEQ ID NO: 3848 - RNA, 19 nt, Artificial Sequence
  Description of Artificial Sequence: Synthetic oligonucleotide
aaucugaaaugaugaaggc

SEQ ID NO: 3849 - RNA, 19 nt, Artificial Sequence
  Description of Artificial Sequence: Synthetic oligonucleotide
ccuucaucauuucagauuu

SEQ ID NO: 3850 - RNA, 19 nt, Artificial Sequence
  Description of Artificial Sequence: Synthetic oligonucleotide
aaaucugaaaugaugaagg

SEQ ID NO: 3851 - RNA, 19 nt, Artificial Sequence
  Description of Artificial Sequence: Synthetic oligonucleotide
agauuuugagucugucagc

SEQ ID NO: 3852 - RNA, 19 nt, Artificial Sequence
  Description of Artificial Sequence: Synthetic oligonucleotide
gcugacagacucaaaaucu

SEQ ID NO: 3853 - RNA, 19 nt, Artificial Sequence
  Description of Artificial Sequence: Synthetic oligonucleotide
uuugagucugucagcaaga

SEQ ID NO: 3854 - RNA, 19 nt, Artificial Sequence
  Description of Artificial Sequence: Synthetic oligonucleotide
ucuugcugacagacucaaa

SEQ ID NO: 3855 - RNA, 19 nt, Artificial Sequence
  Description of Artificial Sequence: Synthetic oligonucleotide
uugagucugucagcaagau

SEQ ID NO: 3856 - RNA, 19 nt, Artificial Sequence
  Description of Artificial Sequence: Synthetic oligonucleotide
aucuugcugacagacucaa

SEQ ID NO: 3857 - RNA, 19 nt, Artificial Sequence
  Description of Artificial Sequence: Synthetic oligonucleotide
ugagucugucagcaagaua

SEQ ID NO: 3858 - RNA, 19 nt, Artificial Sequence
  Description of Artificial Sequence: Synthetic oligonucleotide
uaucuugcugacagacuca

SEQ ID NO: 3859 - RNA, 19 nt, Artificial Sequence
  Description of Artificial Sequence: Synthetic oligonucleotide
gagucugucagcaagauaa

SEQ ID NO: 3860 - RNA, 19 nt, Artificial Sequence
  Description of Artificial Sequence: Synthetic oligonucleotide
uuaucuugcugacagacuc

SEQ ID NO: 3861 - RNA, 19 nt, Artificial Sequence
  Description of Artificial Sequence: Synthetic oligonucleotide
agucugucagcaagauaac

SEQ ID NO: 3862 - RNA, 19 nt, Artificial Sequence
  Description of Artificial Sequence: Synthetic oligonucleotide
guuaucuugcugacagacu

SEQ ID NO: 3863 - RNA, 19 nt, Artificial Sequence
  Description of Artificial Sequence: Synthetic oligonucleotide
gucugucagcaagauaacc

SEQ ID NO: 3864 - RNA, 19 nt, Artificial Sequence
  Description of Artificial Sequence: Synthetic oligonucleotide
gguuaucuugcugacagac

SEQ ID NO: 3865 - RNA, 19 nt, Artificial Sequence
  Description of Artificial Sequence: Synthetic oligonucleotide
ucugucagcaagauaacca

SEQ ID NO: 3866 - RNA, 19 nt, Artificial Sequence
  Description of Artificial Sequence: Synthetic oligonucleotide
ugguuaucuugcugacaga

SEQ ID NO: 3867 - RNA, 19 nt, Artificial Sequence
  Description of Artificial Sequence: Synthetic oligonucleotide
ugucagcaagauaaccaag

SEQ ID NO: 3868 - RNA, 19 nt, Artificial Sequence
  Description of Artificial Sequence: Synthetic oligonucleotide
cuugguuaucuugcugaca

SEQ ID NO: 3869 - RNA, 19 nt, Artificial Sequence
  Description of Artificial Sequence: Synthetic oligonucleotide
gucagcaagauaaccaaga

SEQ ID NO: 3870 - RNA, 19 nt, Artificial Sequence
  Description of Artificial Sequence: Synthetic oligonucleotide
ucuugguuaucuugcugac

SEQ ID NO: 3871 - RNA, 19 nt, Artificial Sequence
  Description of Artificial Sequence: Synthetic oligonucleotide
ucagcaagauaaccaagag

SEQ ID NO: 3872 - RNA, 19 nt, Artificial Sequence
  Description of Artificial Sequence: Synthetic oligonucleotide
cucuugguuaucuugcuga

SEQ ID NO: 3873 - RNA, 19 nt, Artificial Sequence
  Description of Artificial Sequence: Synthetic oligonucleotide
cagcaagauaaccaagagu

SEQ ID NO: 3874 - RNA, 19 nt, Artificial Sequence
  Description of Artificial Sequence: Synthetic oligonucleotide
acucuugguuaucuugcug

SEQ ID NO: 3875 - RNA, 19 nt, Artificial Sequence
  Description of Artificial Sequence: Synthetic oligonucleotide
agcaagauaaccaagagug

SEQ ID NO: 3876 - RNA, 19 nt, Artificial Sequence
  Description of Artificial Sequence: Synthetic oligonucleotide
cacucuugguuaucuugcu

SEQ ID NO: 3877 - RNA, 19 nt, Artificial Sequence
  Description of Artificial Sequence: Synthetic oligonucleotide
gcaagauaaccaagagugg

SEQ ID NO: 3878 - RNA, 19 nt, Artificial Sequence
  Description of Artificial Sequence: Synthetic oligonucleotide
ccacucuugguuaucuugc

SEQ ID NO: 3879 - RNA, 19 nt, Artificial Sequence
  Description of Artificial Sequence: Synthetic oligonucleotide
caagauaaccaagagugga

SEQ ID NO: 3880 - RNA, 19 nt, Artificial Sequence
  Description of Artificial Sequence: Synthetic oligonucleotide
uccacucuugguuaucuug

SEQ ID NO: 3881 - RNA, 19 nt, Artificial Sequence
  Description of Artificial Sequence: Synthetic oligonucleotide
aagauaaccaagaguggag

SEQ ID NO: 3882 - RNA, 19 nt, Artificial Sequence
  Description of Artificial Sequence: Synthetic oligonucleotide
cuccacucuugguuaucuu

SEQ ID NO: 3883 - RNA, 19 nt, Artificial Sequence
  Description of Artificial Sequence: Synthetic oligonucleotide
uaaccaagaguggagucaa

SEQ ID NO: 3884 - RNA, 19 nt, Artificial Sequence
  Description of Artificial Sequence: Synthetic oligonucleotide
uugacuccacucuugguua

SEQ ID NO: 3885 - RNA, 19 nt, Artificial Sequence
  Description of Artificial Sequence: Synthetic oligonucleotide
aaccaagaguggagucaag

SEQ ID NO: 3886 - RNA, 19 nt, Artificial Sequence
  Description of Artificial Sequence: Synthetic oligonucleotide
cuugacuccacucuugguu

SEQ ID NO: 3887 - RNA, 19 nt, Artificial Sequence
  Description of Artificial Sequence: Synthetic oligonucleotide
accaagaguggagucaagg

SEQ ID NO: 3888 - RNA, 19 nt, Artificial Sequence
  Description of Artificial Sequence: Synthetic oligonucleotide
ccuugacuccacucuuggu

SEQ ID NO: 3889 - RNA, 19 nt, Artificial Sequence
  Description of Artificial Sequence: Synthetic oligonucleotide
ccaagaguggagucaaggu

SEQ ID NO: 3890 - RNA, 19 nt, Artificial Sequence
  Description of Artificial Sequence: Synthetic oligonucleotide
accuugacuccacucuugg

SEQ ID NO: 3891 - RNA, 19 nt, Artificial Sequence
  Description of Artificial Sequence: Synthetic oligonucleotide
caagaguggagucaagguu

SEQ ID NO: 3892 - RNA, 19 nt, Artificial Sequence
  Description of Artificial Sequence: Synthetic oligonucleotide
aaccuugacuccacucuug

SEQ ID NO: 3893 - RNA, 19 nt, Artificial Sequence
  Description of Artificial Sequence: Synthetic oligonucleotide
aagaguggagucaagguuu

SEQ ID NO: 3894 - RNA, 19 nt, Artificial Sequence
  Description of Artificial Sequence: Synthetic oligonucleotide
aaaccuugacuccacucuu

SEQ ID NO: 3895 - RNA, 19 nt, Artificial Sequence
  Description of Artificial Sequence: Synthetic oligonucleotide
agaguggagucaagguuuc

SEQ ID NO: 3896 - RNA, 19 nt, Artificial Sequence
  Description of Artificial Sequence: Synthetic oligonucleotide
gaaaccuugacuccacucu

SEQ ID NO: 3897 - RNA, 19 nt, Artificial Sequence
  Description of Artificial Sequence: Synthetic oligonucleotide
gaguggagucaagguuucu

SEQ ID NO: 3898 - RNA, 19 nt, Artificial Sequence
  Description of Artificial Sequence: Synthetic oligonucleotide
agaaaccuugacuccacuc

SEQ ID NO: 3899 - RNA, 19 nt, Artificial Sequence
  Description of Artificial Sequence: Synthetic oligonucleotide
aguggagucaagguuucug

SEQ ID NO: 3900 - RNA, 19 nt, Artificial Sequence
  Description of Artificial Sequence: Synthetic oligonucleotide
cagaaaccuugacuccacu

SEQ ID NO: 3901 - RNA, 19 nt, Artificial Sequence
  Description of Artificial Sequence: Synthetic oligonucleotide
guggagucaagguuucugu

SEQ ID NO: 3902 - RNA, 19 nt, Artificial Sequence
  Description of Artificial Sequence: Synthetic oligonucleotide
acagaaaccuugacuccac

SEQ ID NO: 3903 - RNA, 19 nt, Artificial Sequence
  Description of Artificial Sequence: Synthetic oligonucleotide
uggagucaagguuucuguu

SEQ ID NO: 3904 - RNA, 19 nt, Artificial Sequence
  Description of Artificial Sequence: Synthetic oligonucleotide
aacagaaaccuugacucca

SEQ ID NO: 3905 - RNA, 19 nt, Artificial Sequence
  Description of Artificial Sequence: Synthetic oligonucleotide
ggagucaagguuucuguuu

SEQ ID NO: 3906 - RNA, 19 nt, Artificial Sequence
  Description of Artificial Sequence: Synthetic oligonucleotide
aaacagaaaccuugacucc

SEQ ID NO: 3907 - RNA, 19 nt, Artificial Sequence
  Description of Artificial Sequence: Synthetic oligonucleotide
gagucaagguuucuguuua

SEQ ID NO: 3908 - RNA, 19 nt, Artificial Sequence
  Description of Artificial Sequence: Synthetic oligonucleotide
uaaacagaaaccuugacuc

SEQ ID NO: 3909 - RNA, 19 nt, Artificial Sequence
  Description of Artificial Sequence: Synthetic oligonucleotide
agucaagguuucuguuuau

SEQ ID NO: 3910 - RNA, 19 nt, Artificial Sequence
  Description of Artificial Sequence: Synthetic oligonucleotide
auaaacagaaaccuugacu

SEQ ID NO: 3911 - RNA, 19 nt, Artificial Sequence
  Description of Artificial Sequence: Synthetic oligonucleotide
gucaagguuucuguuuaug

SEQ ID NO: 3912 - RNA, 19 nt, Artificial Sequence
  Description of Artificial Sequence: Synthetic oligonucleotide
cauaaacagaaaccuugac

SEQ ID NO: 3913 - RNA, 19 nt, Artificial Sequence
  Description of Artificial Sequence: Synthetic oligonucleotide
ucaagguuucuguuuaugc

SEQ ID NO: 3914 - RNA, 19 nt, Artificial Sequence
  Description of Artificial Sequence: Synthetic oligonucleotide
gcauaaacagaaaccuuga

SEQ ID NO: 3915 - RNA, 19 nt, Artificial Sequence
  Description of Artificial Sequence: Synthetic oligonucleotide
caagguuucuguuuaugcu

SEQ ID NO: 3916 - RNA, 19 nt, Artificial Sequence
  Description of Artificial Sequence: Synthetic oligonucleotide
agcauaaacagaaaccuug

SEQ ID NO: 3917 - RNA, 19 nt, Artificial Sequence
  Description of Artificial Sequence: Synthetic oligonucleotide
aagguuucuguuuaugcug

SEQ ID NO: 3918 - RNA, 19 nt, Artificial Sequence
  Description of Artificial Sequence: Synthetic oligonucleotide
cagcauaaacagaaaccuu

SEQ ID NO: 3919 - RNA, 19 nt, Artificial Sequence
  Description of Artificial Sequence: Synthetic oligonucleotide
agguuucuguuuaugcugu

SEQ ID NO: 3920 - RNA, 19 nt, Artificial Sequence
  Description of Artificial Sequence: Synthetic oligonucleotide
acagcauaaacagaaaccu

SEQ ID NO: 3921 - RNA, 19 nt, Artificial Sequence
  Description of Artificial Sequence: Synthetic oligonucleotide
uuucuguuuaugcugugcc

SEQ ID NO: 3922 - RNA, 19 nt, Artificial Sequence
  Description of Artificial Sequence: Synthetic oligonucleotide
ggcacagcauaaacagaaa

SEQ ID NO: 3923 - RNA, 19 nt, Artificial Sequence
  Description of Artificial Sequence: Synthetic oligonucleotide
uucuguuuaugcugugcca

SEQ ID NO: 3924 - RNA, 19 nt, Artificial Sequence
  Description of Artificial Sequence: Synthetic oligonucleotide
uggcacagcauaaacagaa

SEQ ID NO: 3925 - RNA, 19 nt, Artificial Sequence
  Description of Artificial Sequence: Synthetic oligonucleotide
cuguuuaugcugugccaga

SEQ ID NO: 3926 - RNA, 19 nt, Artificial Sequence
  Description of Artificial Sequence: Synthetic oligonucleotide
ucuggcacagcauaaacag

SEQ ID NO: 3927 - RNA, 19 nt, Artificial Sequence
  Description of Artificial Sequence: Synthetic oligonucleotide
uguuuaugcugugccagac

SEQ ID NO: 3928 - RNA, 19 nt, Artificial Sequence
  Description of Artificial Sequence: Synthetic oligonucleotide
gucuggcacagcauaaaca

SEQ ID NO: 3929 - RNA, 19 nt, Artificial Sequence
  Description of Artificial Sequence: Synthetic oligonucleotide
guuuaugcugugccagaca

SEQ ID NO: 3930 - RNA, 19 nt, Artificial Sequence
  Description of Artificial Sequence: Synthetic oligonucleotide
ugucuggcacagcauaaac

SEQ ID NO: 3931 - RNA, 19 nt, Artificial Sequence
  Description of Artificial Sequence: Synthetic oligonucleotide
augcacuggaugcugcggu

SEQ ID NO: 3932 - RNA, 19 nt, Artificial Sequence
  Description of Artificial Sequence: Synthetic oligonucleotide
accgcagcauccagugcau

SEQ ID NO: 3933 - RNA, 19 nt, Artificial Sequence
  Description of Artificial Sequence: Synthetic oligonucleotide
ugcacuggaugcugcggug

SEQ ID NO: 3934 - RNA, 19 nt, Artificial Sequence
  Description of Artificial Sequence: Synthetic oligonucleotide
caccgcagcauccagugca

SEQ ID NO: 3935 - RNA, 19 nt, Artificial Sequence
  Description of Artificial Sequence: Synthetic oligonucleotide
gcacuggaugcugcgguga

SEQ ID NO: 3936 - RNA, 19 nt, Artificial Sequence
  Description of Artificial Sequence: Synthetic oligonucleotide
ucaccgcagcauccagugc

SEQ ID NO: 3937 - RNA, 19 nt, Artificial Sequence
  Description of Artificial Sequence: Synthetic oligonucleotide
cacuggaugcugcggugac

SEQ ID NO: 3938 - RNA, 19 nt, Artificial Sequence
  Description of Artificial Sequence: Synthetic oligonucleotide
gucaccgcagcauccagug

SEQ ID NO: 3939 - RNA, 19 nt, Artificial Sequence
  Description of Artificial Sequence: Synthetic oligonucleotide
acuggaugcugcggugacu

SEQ ID NO: 3940 - RNA, 19 nt, Artificial Sequence
  Description of Artificial Sequence: Synthetic oligonucleotide
agucaccgcagcauccagu

SEQ ID NO: 3941 - RNA, 19 nt, Artificial Sequence
  Description of Artificial Sequence: Synthetic oligonucleotide
cuggaugcugcggugacuc

SEQ ID NO: 3942 - RNA, 19 nt, Artificial Sequence
  Description of Artificial Sequence: Synthetic oligonucleotide
gagucaccgcagcauccag

SEQ ID NO: 3943 - RNA, 19 nt, Artificial Sequence
  Description of Artificial Sequence: Synthetic oligonucleotide
uggaugcugcggugacucu

SEQ ID NO: 3944 - RNA, 19 nt, Artificial Sequence
  Description of Artificial Sequence: Synthetic oligonucleotide
agagucaccgcagcaucca

SEQ ID NO: 3945 - RNA, 19 nt, Artificial Sequence
  Description of Artificial Sequence: Synthetic oligonucleotide
ggaugcugcggugacucuu

SEQ ID NO: 3946 - RNA, 19 nt, Artificial Sequence
  Description of Artificial Sequence: Synthetic oligonucleotide
aagagucaccgcagcaucc

SEQ ID NO: 3947 - RNA, 19 nt, Artificial Sequence
  Description of Artificial Sequence: Synthetic oligonucleotide
gaugcugcggugacucuuc

SEQ ID NO: 3948 - RNA, 19 nt, Artificial Sequence
  Description of Artificial Sequence: Synthetic oligonucleotide
gaagagucaccgcagcauc

SEQ ID NO: 3949 - RNA, 19 nt, Artificial Sequence
  Description of Artificial Sequence: Synthetic oligonucleotide
augcugcggugacucuucu

SEQ ID NO: 3950 - RNA, 19 nt, Artificial Sequence
  Description of Artificial Sequence: Synthetic oligonucleotide
agaagagucaccgcagcau

SEQ ID NO: 3951 - RNA, 19 nt, Artificial Sequence
  Description of Artificial Sequence: Synthetic oligonucleotide
ugcugcggugacucuucua

SEQ ID NO: 3952 - RNA, 19 nt, Artificial Sequence
  Description of Artificial Sequence: Synthetic oligonucleotide
uagaagagucaccgcagca

SEQ ID NO: 3953 - RNA, 19 nt, Artificial Sequence
  Description of Artificial Sequence: Synthetic oligonucleotide
gcugcggugacucuucuag

SEQ ID NO: 3954 - RNA, 19 nt, Artificial Sequence
  Description of Artificial Sequence: Synthetic oligonucleotide
cuagaagagucaccgcagc

SEQ ID NO: 3955 - RNA, 19 nt, Artificial Sequence
  Description of Artificial Sequence: Synthetic oligonucleotide
cugcggugacucuucuaga

SEQ ID NO: 3956 - RNA, 19 nt, Artificial Sequence
  Description of Artificial Sequence: Synthetic oligonucleotide
ucuagaagagucaccgcag

SEQ ID NO: 3957 - RNA, 19 nt, Artificial Sequence
  Description of Artificial Sequence: Synthetic oligonucleotide
ugcggugacucuucuagaa

SEQ ID NO: 3958 - RNA, 19 nt, Artificial Sequence
  Description of Artificial Sequence: Synthetic oligonucleotide
uucuagaagagucaccgca

SEQ ID NO: 3959 - RNA, 19 nt, Artificial Sequence
  Description of Artificial Sequence: Synthetic oligonucleotide
gcggugacucuucuagaau

SEQ ID NO: 3960 - RNA, 19 nt, Artificial Sequence
  Description of Artificial Sequence: Synthetic oligonucleotide
auucuagaagagucaccgc

SEQ ID NO: 3961 - RNA, 19 nt, Artificial Sequence
  Description of Artificial Sequence: Synthetic oligonucleotide
cggugacucuucuagaauu

SEQ ID NO: 3962 - RNA, 19 nt, Artificial Sequence
  Description of Artificial Sequence: Synthetic oligonucleotide
aauucuagaagagucaccg

SEQ ID NO: 3963 - RNA, 19 nt, Artificial Sequence
  Description of Artificial Sequence: Synthetic oligonucleotide
cuucuagaauuuuaugagg

SEQ ID NO: 3964 - RNA, 19 nt, Artificial Sequence
  Description of Artificial Sequence: Synthetic oligonucleotide
ccucauaaaauucuagaag

SEQ ID NO: 3965 - RNA, 19 nt, Artificial Sequence
  Description of Artificial Sequence: Synthetic oligonucleotide
caagaucuugcugcuauuc

SEQ ID NO: 3966 - RNA, 19 nt, Artificial Sequence
  Description of Artificial Sequence: Synthetic oligonucleotide
gaauagcagcaagaucuug

SEQ ID NO: 3967 - RNA, 19 nt, Artificial Sequence
  Description of Artificial Sequence: Synthetic oligonucleotide
aagaucuugcugcuauucc

SEQ ID NO: 3968 - RNA, 19 nt, Artificial Sequence
  Description of Artificial Sequence: Synthetic oligonucleotide
ggaauagcagcaagaucuu

SEQ ID NO: 3969 - RNA, 19 nt, Artificial Sequence
  Description of Artificial Sequence: Synthetic oligonucleotide
agaucuugcugcuauuccc

SEQ ID NO: 3970 - RNA, 19 nt, Artificial Sequence
  Description of Artificial Sequence: Synthetic oligonucleotide
gggaauagcagcaagaucu

SEQ ID NO: 3971 - RNA, 19 nt, Artificial Sequence
  Description of Artificial Sequence: Synthetic oligonucleotide
gaucuugcugcuauucccg

SEQ ID NO: 3972 - RNA, 19 nt, Artificial Sequence
  Description of Artificial Sequence: Synthetic oligonucleotide
cgggaauagcagcaagauc

SEQ ID NO: 3973 - RNA, 19 nt, Artificial Sequence
  Description of Artificial Sequence: Synthetic oligonucleotide
uugcugcuauucccgacuu

SEQ ID NO: 3974 - RNA, 19 nt, Artificial Sequence
  Description of Artificial Sequence: Synthetic oligonucleotide
aagucgggaauagcagcaa

SEQ ID NO: 3975 - RNA, 19 nt, Artificial Sequence
  Description of Artificial Sequence: Synthetic oligonucleotide
ugcugcuauucccgacuuu

SEQ ID NO: 3976 - RNA, 19 nt, Artificial Sequence
  Description of Artificial Sequence: Synthetic oligonucleotide
aaagucgggaauagcagca

SEQ ID NO: 3977 - RNA, 19 nt, Artificial Sequence
  Description of Artificial Sequence: Synthetic oligonucleotide
gcugcuauucccgacuuuc

SEQ ID NO: 3978 - RNA, 19 nt, Artificial Sequence
  Description of Artificial Sequence: Synthetic oligonucleotide
gaaagucgggaauagcagc

SEQ ID NO: 3979 - RNA, 19 nt, Artificial Sequence
  Description of Artificial Sequence: Synthetic oligonucleotide
cuuucagucuggugcuaug

SEQ ID NO: 3980 - RNA, 19 nt, Artificial Sequence
  Description of Artificial Sequence: Synthetic oligonucleotide
cauagcaccagacugaaag

SEQ ID NO: 3981 - RNA, 19 nt, Artificial Sequence
  Description of Artificial Sequence: Synthetic oligonucleotide
uuucagucuggugcuaugg

SEQ ID NO: 3982 - RNA, 19 nt, Artificial Sequence
  Description of Artificial Sequence: Synthetic oligonucleotide
ccauagcaccagacugaaa

SEQ ID NO: 3983 - RNA, 19 nt, Artificial Sequence
  Description of Artificial Sequence: Synthetic oligonucleotide
uucagucuggugcuaugga

SEQ ID NO: 3984 - RNA, 19 nt, Artificial Sequence
  Description of Artificial Sequence: Synthetic oligonucleotide
uccauagcaccagacugaa

SEQ ID NO: 3985 - RNA, 19 nt, Artificial Sequence
  Description of Artificial Sequence: Synthetic oligonucleotide
ucagucuggugcuauggaa

SEQ ID NO: 3986 - RNA, 19 nt, Artificial Sequence
  Description of Artificial Sequence: Synthetic oligonucleotide
uuccauagcaccagacuga

SEQ ID NO: 3987 - RNA, 19 nt, Artificial Sequence
  Description of Artificial Sequence: Synthetic oligonucleotide
aaucugcucuguuguuuga

SEQ ID NO: 3988 - RNA, 19 nt, Artificial Sequence
  Description of Artificial Sequence: Synthetic oligonucleotide
ucaaacaacagagcagauu

SEQ ID NO: 3989 - RNA, 19 nt, Artificial Sequence
  Description of Artificial Sequence: Synthetic oligonucleotide
aucugcucuguuguuugau

SEQ ID NO: 3990 - RNA, 19 nt, Artificial Sequence
  Description of Artificial Sequence: Synthetic oligonucleotide
aucaaacaacagagcagau

SEQ ID NO: 3991 - RNA, 19 nt, Artificial Sequence
  Description of Artificial Sequence: Synthetic oligonucleotide
ucugcucuguuguuugaug

SEQ ID NO: 3992 - RNA, 19 nt, Artificial Sequence
  Description of Artificial Sequence: Synthetic oligonucleotide
caucaaacaacagagcaga

SEQ ID NO: 3993 - RNA, 19 nt, Artificial Sequence
  Description of Artificial Sequence: Synthetic oligonucleotide
cugcucuguuguuugaugc

SEQ ID NO: 3994 - RNA, 19 nt, Artificial Sequence
  Description of Artificial Sequence: Synthetic oligonucleotide
gcaucaaacaacagagcag

SEQ ID NO: 3995 - RNA, 19 nt, Artificial Sequence
  Description of Artificial Sequence: Synthetic oligonucleotide
aaaagucuucugcaucaag

SEQ ID NO: 3996 - RNA, 19 nt, Artificial Sequence
  Description of Artificial Sequence: Synthetic oligonucleotide
cuugaugcagaagacuuuu

SEQ ID NO: 3997 - RNA, 19 nt, Artificial Sequence
  Description of Artificial Sequence: Synthetic oligonucleotide
aagucuucugcaucaagua

SEQ ID NO: 3998 - RNA, 19 nt, Artificial Sequence
  Description of Artificial Sequence: Synthetic oligonucleotide
uacuugaugcagaagacuu

SEQ ID NO: 3999 - RNA, 19 nt, Artificial Sequence
  Description of Artificial Sequence: Synthetic oligonucleotide
agucuucugcaucaaguaa

SEQ ID NO: 4000 - RNA, 19 nt, Artificial Sequence
  Description of Artificial Sequence: Synthetic oligonucleotide
uuacuugaugcagaagacu

SEQ ID NO: 4001 - RNA, 19 nt, Artificial Sequence
  Description of Artificial Sequence: Synthetic oligonucleotide
gucuucugcaucaaguaag

SEQ ID NO: 4002 - RNA, 19 nt, Artificial Sequence
  Description of Artificial Sequence: Synthetic oligonucleotide
cuuacuugaugcagaagac

SEQ ID NO: 4003 - RNA, 19 nt, Artificial Sequence
  Description of Artificial Sequence: Synthetic oligonucleotide
ucuucugcaucaaguaagc

SEQ ID NO: 4004 - RNA, 19 nt, Artificial Sequence
  Description of Artificial Sequence: Synthetic oligonucleotide
gcuuacuugaugcagaaga

SEQ ID NO: 4005 - RNA, 19 nt, Artificial Sequence
  Description of Artificial Sequence: Synthetic oligonucleotide
aaccuggucacuauggaau

SEQ ID NO: 4006 - RNA, 19 nt, Artificial Sequence
  Description of Artificial Sequence: Synthetic oligonucleotide
auuccauagugaccagguu

SEQ ID NO: 4007 - RNA, 19 nt, Artificial Sequence
  Description of Artificial Sequence: Synthetic oligonucleotide
accuggucacuauggaaug

SEQ ID NO: 4008 - RNA, 19 nt, Artificial Sequence
  Description of Artificial Sequence: Synthetic oligonucleotide
cauuccauagugaccaggu

SEQ ID NO: 4009 - RNA, 19 nt, Artificial Sequence
  Description of Artificial Sequence: Synthetic oligonucleotide
ccuggucacuauggaaugg

SEQ ID NO: 4010 - RNA, 19 nt, Artificial Sequence
  Description of Artificial Sequence: Synthetic oligonucleotide
ccauuccauagugaccagg

SEQ ID NO: 4011 - RNA, 19 nt, Artificial Sequence
  Description of Artificial Sequence: Synthetic oligonucleotide
cuggucacuauggaauggu

SEQ ID NO: 4012 - RNA, 19 nt, Artificial Sequence
  Description of Artificial Sequence: Synthetic oligonucleotide
accauuccauagugaccag

SEQ ID NO: 4013 - RNA, 19 nt, Artificial Sequence
  Description of Artificial Sequence: Synthetic oligonucleotide
uggucacuauggaauggug

SEQ ID NO: 4014 - RNA, 19 nt, Artificial Sequence
  Description of Artificial Sequence: Synthetic oligonucleotide
caccauuccauagugacca

SEQ ID NO: 4015 - RNA, 19 nt, Artificial Sequence
  Description of Artificial Sequence: Synthetic oligonucleotide
ggucacuauggaauggugg

SEQ ID NO: 4016 - RNA, 19 nt, Artificial Sequence
  Description of Artificial Sequence: Synthetic oligonucleotide
ccaccauuccauagugacc

SEQ ID NO: 4017 - RNA, 19 nt, Artificial Sequence
  Description of Artificial Sequence: Synthetic oligonucleotide
gucacuauggaauggugga

SEQ ID NO: 4018 - RNA, 19 nt, Artificial Sequence
  Description of Artificial Sequence: Synthetic oligonucleotide
uccaccauuccauagugac

SEQ ID NO: 4019 - RNA, 19 nt, Artificial Sequence
  Description of Artificial Sequence: Synthetic oligonucleotide
ucacuauggaaugguggaa

SEQ ID NO: 4020 - RNA, 19 nt, Artificial Sequence
  Description of Artificial Sequence: Synthetic oligonucleotide
uuccaccauuccauaguga

SEQ ID NO: 4021 - RNA, 19 nt, Artificial Sequence
  Description of Artificial Sequence: Synthetic oligonucleotide
cacuauggaaugguggaau

SEQ ID NO: 4022 - RNA, 19 nt, Artificial Sequence
  Description of Artificial Sequence: Synthetic oligonucleotide
auuccaccauuccauagug

SEQ ID NO: 4023 - RNA, 19 nt, Artificial Sequence
  Description of Artificial Sequence: Synthetic oligonucleotide
acuauggaaugguggaaug

SEQ ID NO: 4024 - RNA, 19 nt, Artificial Sequence
  Description of Artificial Sequence: Synthetic oligonucleotide
cauuccaccauuccauagu

SEQ ID NO: 4025 - RNA, 19 nt, Artificial Sequence
  Description of Artificial Sequence: Synthetic oligonucleotide
uggaaugguggaaugaucu

SEQ ID NO: 4026 - RNA, 19 nt, Artificial Sequence
  Description of Artificial Sequence: Synthetic oligonucleotide
agaucauuccaccauucca

SEQ ID NO: 4027 - RNA, 19 nt, Artificial Sequence
  Description of Artificial Sequence: Synthetic oligonucleotide
ggaaugguggaaugaucuu

SEQ ID NO: 4028 - RNA, 19 nt, Artificial Sequence
  Description of Artificial Sequence: Synthetic oligonucleotide
aagaucauuccaccauucc

SEQ ID NO: 4029 - RNA, 19 nt, Artificial Sequence
  Description of Artificial Sequence: Synthetic oligonucleotide
gaaugguggaaugaucuuu

SEQ ID NO: 4030 - RNA, 19 nt, Artificial Sequence
  Description of Artificial Sequence: Synthetic oligonucleotide
aaagaucauuccaccauuc

SEQ ID NO: 4031 - RNA, 19 nt, Artificial Sequence
  Description of Artificial Sequence: Synthetic oligonucleotide
aaugguggaaugaucuuug

SEQ ID NO: 4032 - RNA, 19 nt, Artificial Sequence
  Description of Artificial Sequence: Synthetic oligonucleotide
caaagaucauuccaccauu

SEQ ID NO: 4033 - RNA, 19 nt, Artificial Sequence
  Description of Artificial Sequence: Synthetic oligonucleotide
augguggaaugaucuuugg

SEQ ID NO: 4034 - RNA, 19 nt, Artificial Sequence
  Description of Artificial Sequence: Synthetic oligonucleotide
ccaaagaucauuccaccau

SEQ ID NO: 4035 - RNA, 19 nt, Artificial Sequence
  Description of Artificial Sequence: Synthetic oligonucleotide
ugguggaaugaucuuuggc

SEQ ID NO: 4036 - RNA, 19 nt, Artificial Sequence
  Description of Artificial Sequence: Synthetic oligonucleotide
gccaaagaucauuccacca

SEQ ID NO: 4037 - RNA, 19 nt, Artificial Sequence
  Description of Artificial Sequence: Synthetic oligonucleotide
gguggaaugaucuuuggcu

SEQ ID NO: 4038 - RNA, 19 nt, Artificial Sequence
  Description of Artificial Sequence: Synthetic oligonucleotide
agccaaagaucauuccacc

SEQ ID NO: 4039 - RNA, 19 nt, Artificial Sequence
  Description of Artificial Sequence: Synthetic oligonucleotide
guggaaugaucuuuggcua

SEQ ID NO: 4040 - RNA, 19 nt, Artificial Sequence
  Description of Artificial Sequence: Synthetic oligonucleotide
uagccaaagaucauuccac

SEQ ID NO: 4041 - RNA, 19 nt, Artificial Sequence
  Description of Artificial Sequence: Synthetic oligonucleotide
uggaaugaucuuuggcuaa

SEQ ID NO: 4042 - RNA, 19 nt, Artificial Sequence
  Description of Artificial Sequence: Synthetic oligonucleotide
uuagccaaagaucauucca

SEQ ID NO: 4043 - RNA, 19 nt, Artificial Sequence
  Description of Artificial Sequence: Synthetic oligonucleotide
ggaaugaucuuuggcuaaa

SEQ ID NO: 4044 - RNA, 19 nt, Artificial Sequence
  Description of Artificial Sequence: Synthetic oligonucleotide
uuuagccaaagaucauucc

SEQ ID NO: 4045 - RNA, 19 nt, Artificial Sequence
  Description of Artificial Sequence: Synthetic oligonucleotide
gaaugaucuuuggcuaaau

SEQ ID NO: 4046 - RNA, 19 nt, Artificial Sequence
  Description of Artificial Sequence: Synthetic oligonucleotide
auuuagccaaagaucauuc

SEQ ID NO: 4047 - RNA, 19 nt, Artificial Sequence
  Description of Artificial Sequence: Synthetic oligonucleotide
aaugaucuuuggcuaaaug

SEQ ID NO: 4048 - RNA, 19 nt, Artificial Sequence
  Description of Artificial Sequence: Synthetic oligonucleotide
cauuuagccaaagaucauu

SEQ ID NO: 4049 - RNA, 19 nt, Artificial Sequence
  Description of Artificial Sequence: Synthetic oligonucleotide
aauuuauggaguuuguguc

SEQ ID NO: 4050 - RNA, 19 nt, Artificial Sequence
  Description of Artificial Sequence: Synthetic oligonucleotide
gacacaaacuccauaaauu

SEQ ID NO: 4051 - RNA, 19 nt, Artificial Sequence
  Description of Artificial Sequence: Synthetic oligonucleotide
auuuauggaguuugugucu

SEQ ID NO: 4052 - RNA, 19 nt, Artificial Sequence
  Description of Artificial Sequence: Synthetic oligonucleotide
agacacaaacuccauaaau

SEQ ID NO: 4053 - RNA, 19 nt, Artificial Sequence
  Description of Artificial Sequence: Synthetic oligonucleotide
uuuauggaguuugugucug

SEQ ID NO: 4054 - RNA, 19 nt, Artificial Sequence
  Description of Artificial Sequence: Synthetic oligonucleotide
cagacacaaacuccauaaa

SEQ ID NO: 4055 - RNA, 19 nt, Artificial Sequence
  Description of Artificial Sequence: Synthetic oligonucleotide
uuauggaguuugugucugu

SEQ ID NO: 4056 - RNA, 19 nt, Artificial Sequence
  Description of Artificial Sequence: Synthetic oligonucleotide
acagacacaaacuccauaa

SEQ ID NO: 4057 - RNA, 19 nt, Artificial Sequence
  Description of Artificial Sequence: Synthetic oligonucleotide
uauggaguuugugucuguc

SEQ ID NO: 4058 - RNA, 19 nt, Artificial Sequence
  Description of Artificial Sequence: Synthetic oligonucleotide
gacagacacaaacuccaua

SEQ ID NO: 4059 - RNA, 19 nt, Artificial Sequence
  Description of Artificial Sequence: Synthetic oligonucleotide
auggaguuugugucuguca

SEQ ID NO: 4060 - RNA, 19 nt, Artificial Sequence
  Description of Artificial Sequence: Synthetic oligonucleotide
ugacagacacaaacuccau

SEQ ID NO: 4061 - RNA, 19 nt, Artificial Sequence
  Description of Artificial Sequence: Synthetic oligonucleotide
uggaguuugugucugucag

SEQ ID NO: 4062 - RNA, 19 nt, Artificial Sequence
  Description of Artificial Sequence: Synthetic oligonucleotide
cugacagacacaaacucca

SEQ ID NO: 4063 - RNA, 19 nt, Artificial Sequence
  Description of Artificial Sequence: Synthetic oligonucleotide
ggaguuugugucugucagu

SEQ ID NO: 4064 - RNA, 19 nt, Artificial Sequence
  Description of Artificial Sequence: Synthetic oligonucleotide
acugacagacacaaacucc

SEQ ID NO: 4065 - RNA, 19 nt, Artificial Sequence
  Description of Artificial Sequence: Synthetic oligonucleotide
gaguuugugucugucagug

SEQ ID NO: 4066 - RNA, 19 nt, Artificial Sequence
  Description of Artificial Sequence: Synthetic oligonucleotide
cacugacagacacaaacuc

SEQ ID NO: 4067 - RNA, 19 nt, Artificial Sequence
  Description of Artificial Sequence: Synthetic oligonucleotide
aguuugugucugucagugu

SEQ ID NO: 4068 - RNA, 19 nt, Artificial Sequence
  Description of Artificial Sequence: Synthetic oligonucleotide
acacugacagacacaaacu

SEQ ID NO: 4069 - RNA, 19 nt, Artificial Sequence
  Description of Artificial Sequence: Synthetic oligonucleotide
cagugugacccauccugaa

SEQ ID NO: 4070 - RNA, 19 nt, Artificial Sequence
  Description of Artificial Sequence: Synthetic oligonucleotide
uucaggaugggucacacug

SEQ ID NO: 4071 - RNA, 19 nt, Artificial Sequence
  Description of Artificial Sequence: Synthetic oligonucleotide
gcaauggagguagaugcuu

SEQ ID NO: 4072 - RNA, 19 nt, Artificial Sequence
  Description of Artificial Sequence: Synthetic oligonucleotide
aagcaucuaccuccauugc

SEQ ID NO: 4073 - RNA, 19 nt, Artificial Sequence
  Description of Artificial Sequence: Synthetic oligonucleotide
agguagaugcuuuaaauuc

SEQ ID NO: 4074 - RNA, 19 nt, Artificial Sequence
  Description of Artificial Sequence: Synthetic oligonucleotide
gaauuuaaagcaucuaccu

SEQ ID NO: 4075 - RNA, 19 nt, Artificial Sequence
  Description of Artificial Sequence: Synthetic oligonucleotide
gguagaugcuuuaaauucc

SEQ ID NO: 4076 - RNA, 19 nt, Artificial Sequence
  Description of Artificial Sequence: Synthetic oligonucleotide
ggaauuuaaagcaucuacc

SEQ ID NO: 4077 - RNA, 19 nt, Artificial Sequence
  Description of Artificial Sequence: Synthetic oligonucleotide
guagaugcuuuaaauuccu

SEQ ID NO: 4078 - RNA, 19 nt, Artificial Sequence
  Description of Artificial Sequence: Synthetic oligonucleotide
aggaauuuaaagcaucuac

SEQ ID NO: 4079 - RNA, 19 nt, Artificial Sequence
  Description of Artificial Sequence: Synthetic oligonucleotide
uagaugcuuuaaauuccuc

SEQ ID NO: 4080 - RNA, 19 nt, Artificial Sequence
  Description of Artificial Sequence: Synthetic oligonucleotide
gaggaauuuaaagcaucua

SEQ ID NO: 4081 - RNA, 19 nt, Artificial Sequence
  Description of Artificial Sequence: Synthetic oligonucleotide
ccugugucuacaccugugg

SEQ ID NO: 4082 - RNA, 19 nt, Artificial Sequence
  Description of Artificial Sequence: Synthetic oligonucleotide
ccacagguguagacacagg

SEQ ID NO: 4083 - RNA, 19 nt, Artificial Sequence
  Description of Artificial Sequence: Synthetic oligonucleotide
ugugucuacaccuguggaa

SEQ ID NO: 4084 - RNA, 19 nt, Artificial Sequence
  Description of Artificial Sequence: Synthetic oligonucleotide
uuccacagguguagacaca

SEQ ID NO: 4085 - RNA, 19 nt, Artificial Sequence
  Description of Artificial Sequence: Synthetic oligonucleotide
uaugauaagggagcuugua

SEQ ID NO: 4086 - RNA, 19 nt, Artificial Sequence
  Description of Artificial Sequence: Synthetic oligonucleotide
uacaagcucccuuaucaua

SEQ ID NO: 4087 - RNA, 19 nt, Artificial Sequence
  Description of Artificial Sequence: Synthetic oligonucleotide
auaagggagcuuguauucu

SEQ ID NO: 4088 - RNA, 19 nt, Artificial Sequence
  Description of Artificial Sequence: Synthetic oligonucleotide
agaauacaagcucccuuau

SEQ ID NO: 4089 - RNA, 19 nt, Artificial Sequence
  Description of Artificial Sequence: Synthetic oligonucleotide
uaagggagcuuguauucug

SEQ ID NO: 4090 - RNA, 19 nt, Artificial Sequence
  Description of Artificial Sequence: Synthetic oligonucleotide
cagaauacaagcucccuua

SEQ ID NO: 4091 - RNA, 19 nt, Artificial Sequence
  Description of Artificial Sequence: Synthetic oligonucleotide
aagggagcuuguauucuga

SEQ ID NO: 4092 - RNA, 19 nt, Artificial Sequence
  Description of Artificial Sequence: Synthetic oligonucleotide
ucagaauacaagcucccuu

SEQ ID NO: 4093 - RNA, 19 nt, Artificial Sequence
  Description of Artificial Sequence: Synthetic oligonucleotide
agggagcuuguauucugaa

SEQ ID NO: 4094 - RNA, 19 nt, Artificial Sequence
  Description of Artificial Sequence: Synthetic oligonucleotide
uucagaauacaagcucccu

SEQ ID NO: 4095 - RNA, 19 nt, Artificial Sequence
  Description of Artificial Sequence: Synthetic oligonucleotide
auucugaauaugcuaaggg

SEQ ID NO: 4096 - RNA, 19 nt, Artificial Sequence
  Description of Artificial Sequence: Synthetic oligonucleotide
cccuuagcauauucagaau

SEQ ID NO: 4097 - RNA, 19 nt, Artificial Sequence
  Description of Artificial Sequence: Synthetic oligonucleotide
gaauaugcuaagggaguau

SEQ ID NO: 4098 - RNA, 19 nt, Artificial Sequence
  Description of Artificial Sequence: Synthetic oligonucleotide
auacucccuuagcauauuc

SEQ ID NO: 4099 - RNA, 19 nt, Artificial Sequence
  Description of Artificial Sequence: Synthetic oligonucleotide
aauaugcuaagggaguauc

SEQ ID NO: 4100 - RNA, 19 nt, Artificial Sequence
  Description of Artificial Sequence: Synthetic oligonucleotide
gauacucccuuagcauauu

SEQ ID NO: 4101 - RNA, 19 nt, Artificial Sequence
  Description of Artificial Sequence: Synthetic oligonucleotide
auaugcuaagggaguaucu

SEQ ID NO: 4102 - RNA, 19 nt, Artificial Sequence
  Description of Artificial Sequence: Synthetic oligonucleotide
agauacucccuuagcauau

SEQ ID NO: 4103 - RNA, 19 nt, Artificial Sequence
  Description of Artificial Sequence: Synthetic oligonucleotide
uaugcuaagggaguaucuu

SEQ ID NO: 4104 - RNA, 19 nt, Artificial Sequence
  Description of Artificial Sequence: Synthetic oligonucleotide
aagauacucccuuagcaua

SEQ ID NO: 4105 - RNA, 19 nt, Artificial Sequence
  Description of Artificial Sequence: Synthetic oligonucleotide
gcugacgcauuuaaaagug

SEQ ID NO: 4106 - RNA, 19 nt, Artificial Sequence
  Description of Artificial Sequence: Synthetic oligonucleotide
cacuuuuaaaugcgucagc

SEQ ID NO: 4107 - RNA, 19 nt, Artificial Sequence
  Description of Artificial Sequence: Synthetic oligonucleotide
cugacgcauuuaaaagugg

SEQ ID NO: 4108 - RNA, 19 nt, Artificial Sequence
  Description of Artificial Sequence: Synthetic oligonucleotide
ccacuuuuaaaugcgucag

SEQ ID NO: 4109 - RNA, 19 nt, Artificial Sequence
  Description of Artificial Sequence: Synthetic oligonucleotide
ugacgcauuuaaaaguggu

SEQ ID NO: 4110 - RNA, 19 nt, Artificial Sequence
  Description of Artificial Sequence: Synthetic oligonucleotide
accacuuuuaaaugcguca

SEQ ID NO: 4111 - RNA, 19 nt, Artificial Sequence
  Description of Artificial Sequence: Synthetic oligonucleotide
gacgcauuuaaaaguggua

SEQ ID NO: 4112 - RNA, 19 nt, Artificial Sequence
  Description of Artificial Sequence: Synthetic oligonucleotide
uaccacuuuuaaaugcguc

SEQ ID NO: 4113 - RNA, 19 nt, Artificial Sequence
  Description of Artificial Sequence: Synthetic oligonucleotide
acgcauuuaaaagugguau

SEQ ID NO: 4114 - RNA, 19 nt, Artificial Sequence
  Description of Artificial Sequence: Synthetic oligonucleotide
auaccacuuuuaaaugcgu

SEQ ID NO: 4115 - RNA, 19 nt, Artificial Sequence
  Description of Artificial Sequence: Synthetic oligonucleotide
cgcauuuaaaagugguauu

SEQ ID NO: 4116 - RNA, 19 nt, Artificial Sequence
  Description of Artificial Sequence: Synthetic oligonucleotide
aauaccacuuuuaaaugcg

SEQ ID NO: 4117 - RNA, 19 nt, Artificial Sequence
  Description of Artificial Sequence: Synthetic oligonucleotide
gcauuuaaaagugguauug

SEQ ID NO: 4118 - RNA, 19 nt, Artificial Sequence
  Description of Artificial Sequence: Synthetic oligonucleotide
caauaccacuuuuaaaugc

SEQ ID NO: 4119 - RNA, 19 nt, Artificial Sequence
  Description of Artificial Sequence: Synthetic oligonucleotide
aaagugguauuguacagua

SEQ ID NO: 4120 - RNA, 19 nt, Artificial Sequence
  Description of Artificial Sequence: Synthetic oligonucleotide
uacuguacaauaccacuuu

SEQ ID NO: 4121 - RNA, 19 nt, Artificial Sequence
  Description of Artificial Sequence: Synthetic oligonucleotide
aagugguauuguacaguau

SEQ ID NO: 4122 - RNA, 19 nt, Artificial Sequence
  Description of Artificial Sequence: Synthetic oligonucleotide
auacuguacaauaccacuu

SEQ ID NO: 4123 - RNA, 19 nt, Artificial Sequence
  Description of Artificial Sequence: Synthetic oligonucleotide
agugguauuguacaguauc

SEQ ID NO: 4124 - RNA, 19 nt, Artificial Sequence
  Description of Artificial Sequence: Synthetic oligonucleotide
gauacuguacaauaccacu

SEQ ID NO: 4125 - RNA, 19 nt, Artificial Sequence
  Description of Artificial Sequence: Synthetic oligonucleotide
gugguauuguacaguaucu

SEQ ID NO: 4126 - RNA, 19 nt, Artificial Sequence
  Description of Artificial Sequence: Synthetic oligonucleotide
agauacuguacaauaccac

SEQ ID NO: 4127 - RNA, 19 nt, Artificial Sequence
  Description of Artificial Sequence: Synthetic oligonucleotide
ugguauuguacaguaucuc

SEQ ID NO: 4128 - RNA, 19 nt, Artificial Sequence
  Description of Artificial Sequence: Synthetic oligonucleotide
gagauacuguacaauacca

SEQ ID NO: 4129 - RNA, 19 nt, Artificial Sequence
  Description of Artificial Sequence: Synthetic oligonucleotide
gguauuguacaguaucucc

SEQ ID NO: 4130 - RNA, 19 nt, Artificial Sequence
  Description of Artificial Sequence: Synthetic oligonucleotide
ggagauacuguacaauacc

SEQ ID NO: 4131 - RNA, 19 nt, Artificial Sequence
  Description of Artificial Sequence: Synthetic oligonucleotide
guauuguacaguaucucca

SEQ ID NO: 4132 - RNA, 19 nt, Artificial Sequence
  Description of Artificial Sequence: Synthetic oligonucleotide
uggagauacuguacaauac

SEQ ID NO: 4133 - RNA, 19 nt, Artificial Sequence
  Description of Artificial Sequence: Synthetic oligonucleotide
uauuguacaguaucuccag

SEQ ID NO: 4134 - RNA, 19 nt, Artificial Sequence
  Description of Artificial Sequence: Synthetic oligonucleotide
cuggagauacuguacaaua

SEQ ID NO: 4135 - RNA, 19 nt, Artificial Sequence
  Description of Artificial Sequence: Synthetic oligonucleotide
auuguacaguaucuccaga

SEQ ID NO: 4136 - RNA, 19 nt, Artificial Sequence
  Description of Artificial Sequence: Synthetic oligonucleotide
ucuggagauacuguacaau

SEQ ID NO: 4137 - RNA, 19 nt, Artificial Sequence
  Description of Artificial Sequence: Synthetic oligonucleotide
uuguacaguaucuccagaa

SEQ ID NO: 4138 - RNA, 19 nt, Artificial Sequence
  Description of Artificial Sequence: Synthetic oligonucleotide
uucuggagauacuguacaa

SEQ ID NO: 4139 - RNA, 19 nt, Artificial Sequence
  Description of Artificial Sequence: Synthetic oligonucleotide
uguacaguaucuccagaag

SEQ ID NO: 4140 - RNA, 19 nt, Artificial Sequence
  Description of Artificial Sequence: Synthetic oligonucleotide
cuucuggagauacuguaca

SEQ ID NO: 4141 - RNA, 19 nt, Artificial Sequence
  Description of Artificial Sequence: Synthetic oligonucleotide
cuccagaagcauagcuaua

SEQ ID NO: 4142 - RNA, 19 nt, Artificial Sequence
  Description of Artificial Sequence: Synthetic oligonucleotide
uauagcuaugcuucuggag

SEQ ID NO: 4143 - RNA, 19 nt, Artificial Sequence
  Description of Artificial Sequence: Synthetic oligonucleotide
uccagaagcauagcuauaa

SEQ ID NO: 4144 - RNA, 19 nt, Artificial Sequence
  Description of Artificial Sequence: Synthetic oligonucleotide
uuauagcuaugcuucugga

SEQ ID NO: 4145 - RNA, 19 nt, Artificial Sequence
  Description of Artificial Sequence: Synthetic oligonucleotide
ccagaagcauagcuauaaa

SEQ ID NO: 4146 - RNA, 19 nt, Artificial Sequence
  Description of Artificial Sequence: Synthetic oligonucleotide
uuuauagcuaugcuucugg

SEQ ID NO: 4147 - RNA, 19 nt, Artificial Sequence
  Description of Artificial Sequence: Synthetic oligonucleotide
acgaggaccugugggauag

SEQ ID NO: 4148 - RNA, 19 nt, Artificial Sequence
  Description of Artificial Sequence: Synthetic oligonucleotide
cuaucccacagguccucgu

SEQ ID NO: 4149 - RNA, 19 nt, Artificial Sequence
  Description of Artificial Sequence: Synthetic oligonucleotide
cgaggaccugugggauagu

SEQ ID NO: 4150 - RNA, 19 nt, Artificial Sequence
  Description of Artificial Sequence: Synthetic oligonucleotide
acuaucccacagguccucg

SEQ ID NO: 4151 - RNA, 19 nt, Artificial Sequence
  Description of Artificial Sequence: Synthetic oligonucleotide
gaggaccugugggauagua

SEQ ID NO: 4152 - RNA, 19 nt, Artificial Sequence
  Description of Artificial Sequence: Synthetic oligonucleotide
uacuaucccacagguccuc

SEQ ID NO: 4153 - RNA, 19 nt, Artificial Sequence
  Description of Artificial Sequence: Synthetic oligonucleotide
aggaccugugggauaguau

SEQ ID NO: 4154 - RNA, 19 nt, Artificial Sequence
  Description of Artificial Sequence: Synthetic oligonucleotide
auacuaucccacagguccu

SEQ ID NO: 4155 - RNA, 19 nt, Artificial Sequence
  Description of Artificial Sequence: Synthetic oligonucleotide
ggaccugugggauaguaug

SEQ ID NO: 4156 - RNA, 19 nt, Artificial Sequence
  Description of Artificial Sequence: Synthetic oligonucleotide
cauacuaucccacaggucc

SEQ ID NO: 4157 - RNA, 19 nt, Artificial Sequence
  Description of Artificial Sequence: Synthetic oligonucleotide
gaccugugggauaguaugg

SEQ ID NO: 4158 - RNA, 19 nt, Artificial Sequence
  Description of Artificial Sequence: Synthetic oligonucleotide
ccauacuaucccacagguc

SEQ ID NO: 4159 - RNA, 19 nt, Artificial Sequence
  Description of Artificial Sequence: Synthetic oligonucleotide
accugugggauaguauggc

SEQ ID NO: 4160 - RNA, 19 nt, Artificial Sequence
  Description of Artificial Sequence: Synthetic oligonucleotide
gccauacuaucccacaggu

SEQ ID NO: 4161 - RNA, 19 nt, Artificial Sequence
  Description of Artificial Sequence: Synthetic oligonucleotide
ccugugggauaguauggca

SEQ ID NO: 4162 - RNA, 19 nt, Artificial Sequence
  Description of Artificial Sequence: Synthetic oligonucleotide
ugccauacuaucccacagg

SEQ ID NO: 4163 - RNA, 19 nt, Artificial Sequence
  Description of Artificial Sequence: Synthetic oligonucleotide
cugugggauaguauggcaa

SEQ ID NO: 4164 - RNA, 19 nt, Artificial Sequence
  Description of Artificial Sequence: Synthetic oligonucleotide
uugccauacuaucccacag

SEQ ID NO: 4165 - RNA, 19 nt, Artificial Sequence
  Description of Artificial Sequence: Synthetic oligonucleotide
ugugggauaguauggcaag

SEQ ID NO: 4166 - RNA, 19 nt, Artificial Sequence
  Description of Artificial Sequence: Synthetic oligonucleotide
cuugccauacuaucccaca

SEQ ID NO: 4167 - RNA, 19 nt, Artificial Sequence
  Description of Artificial Sequence: Synthetic oligonucleotide
gugggauaguauggcaagu

SEQ ID NO: 4168 - RNA, 19 nt, Artificial Sequence
  Description of Artificial Sequence: Synthetic oligonucleotide
acuugccauacuaucccac

SEQ ID NO: 4169 - RNA, 19 nt, Artificial Sequence
  Description of Artificial Sequence: Synthetic oligonucleotide
ugggauaguauggcaagua

SEQ ID NO: 4170 - RNA, 19 nt, Artificial Sequence
  Description of Artificial Sequence: Synthetic oligonucleotide
uacuugccauacuauccca

SEQ ID NO: 4171 - RNA, 19 nt, Artificial Sequence
  Description of Artificial Sequence: Synthetic oligonucleotide
gggauaguauggcaaguau

SEQ ID NO: 4172 - RNA, 19 nt, Artificial Sequence
  Description of Artificial Sequence: Synthetic oligonucleotide
auacuugccauacuauccc

SEQ ID NO: 4173 - RNA, 19 nt, Artificial Sequence
  Description of Artificial Sequence: Synthetic oligonucleotide
aaguauuugcccuacagau

SEQ ID NO: 4174 - RNA, 19 nt, Artificial Sequence
  Description of Artificial Sequence: Synthetic oligonucleotide
aucuguagggcaaauacuu

SEQ ID NO: 4175 - RNA, 19 nt, Artificial Sequence
  Description of Artificial Sequence: Synthetic oligonucleotide
aguauuugcccuacagaug

SEQ ID NO: 4176 - RNA, 19 nt, Artificial Sequence
  Description of Artificial Sequence: Synthetic oligonucleotide
caucuguagggcaaauacu

SEQ ID NO: 4177 - RNA, 19 nt, Artificial Sequence
  Description of Artificial Sequence: Synthetic oligonucleotide
guauuugcccuacagaugg

SEQ ID NO: 4178 - RNA, 19 nt, Artificial Sequence
  Description of Artificial Sequence: Synthetic oligonucleotide
ccaucuguagggcaaauac

SEQ ID NO: 4179 - RNA, 19 nt, Artificial Sequence
  Description of Artificial Sequence: Synthetic oligonucleotide
uauuugcccuacagauggu

SEQ ID NO: 4180 - RNA, 19 nt, Artificial Sequence
  Description of Artificial Sequence: Synthetic oligonucleotide
accaucuguagggcaaaua

SEQ ID NO: 4181 - RNA, 19 nt, Artificial Sequence
  Description of Artificial Sequence: Synthetic oligonucleotide
auuugcccuacagauggug

SEQ ID NO: 4182 - RNA, 19 nt, Artificial Sequence
  Description of Artificial Sequence: Synthetic oligonucleotide
caccaucuguagggcaaau

SEQ ID NO: 4183 - RNA, 19 nt, Artificial Sequence
  Description of Artificial Sequence: Synthetic oligonucleotide
uuugcccuacagauggugu

SEQ ID NO: 4184 - RNA, 19 nt, Artificial Sequence
  Description of Artificial Sequence: Synthetic oligonucleotide
acaccaucuguagggcaaa

SEQ ID NO: 4185 - RNA, 19 nt, Artificial Sequence
  Description of Artificial Sequence: Synthetic oligonucleotide
ugguguaaaagggauggau

SEQ ID NO: 4186 - RNA, 19 nt, Artificial Sequence
  Description of Artificial Sequence: Synthetic oligonucleotide
auccaucccuuuuacacca

SEQ ID NO: 4187 - RNA, 19 nt, Artificial Sequence
  Description of Artificial Sequence: Synthetic oligonucleotide
gguguaaaagggauggaug

SEQ ID NO: 4188 - RNA, 19 nt, Artificial Sequence
  Description of Artificial Sequence: Synthetic oligonucleotide
cauccaucccuuuuacacc

SEQ ID NO: 4189 - RNA, 19 nt, Artificial Sequence
  Description of Artificial Sequence: Synthetic oligonucleotide
guguaaaagggauggaugg

SEQ ID NO: 4190 - RNA, 19 nt, Artificial Sequence
  Description of Artificial Sequence: Synthetic oligonucleotide
ccauccaucccuuuuacac

SEQ ID NO: 4191 - RNA, 19 nt, Artificial Sequence
  Description of Artificial Sequence: Synthetic oligonucleotide
uguaaaagggauggauggc

SEQ ID NO: 4192 - RNA, 19 nt, Artificial Sequence
  Description of Artificial Sequence: Synthetic oligonucleotide
gccauccaucccuuuuaca

SEQ ID NO: 4193 - RNA, 19 nt, Artificial Sequence
  Description of Artificial Sequence: Synthetic oligonucleotide
aagggauggauggcuuuug

SEQ ID NO: 4194 - RNA, 19 nt, Artificial Sequence
  Description of Artificial Sequence: Synthetic oligonucleotide
caaaagccauccaucccuu

SEQ ID NO: 4195 - RNA, 19 nt, Artificial Sequence
  Description of Artificial Sequence: Synthetic oligonucleotide
agggauggauggcuuuugc

SEQ ID NO: 4196 - RNA, 19 nt, Artificial Sequence
  Description of Artificial Sequence: Synthetic oligonucleotide
gcaaaagccauccaucccu

SEQ ID NO: 4197 - RNA, 19 nt, Artificial Sequence
  Description of Artificial Sequence: Synthetic oligonucleotide
gggauggauggcuuuugcu

SEQ ID NO: 4198 - RNA, 19 nt, Artificial Sequence
  Description of Artificial Sequence: Synthetic oligonucleotide
agcaaaagccauccauccc

SEQ ID NO: 4199 - RNA, 19 nt, Artificial Sequence
  Description of Artificial Sequence: Synthetic oligonucleotide
gauggauggcuuuugcucu

SEQ ID NO: 4200 - RNA, 19 nt, Artificial Sequence
  Description of Artificial Sequence: Synthetic oligonucleotide
agagcaaaagccauccauc

SEQ ID NO: 4201 - RNA, 19 nt, Artificial Sequence
  Description of Artificial Sequence: Synthetic oligonucleotide
auggauggcuuuugcucua

SEQ ID NO: 4202 - RNA, 19 nt, Artificial Sequence
  Description of Artificial Sequence: Synthetic oligonucleotide
uagagcaaaagccauccau

SEQ ID NO: 4203 - RNA, 19 nt, Artificial Sequence
  Description of Artificial Sequence: Synthetic oligonucleotide
uggauggcuuuugcucuag

SEQ ID NO: 4204 - RNA, 19 nt, Artificial Sequence
  Description of Artificial Sequence: Synthetic oligonucleotide
cuagagcaaaagccaucca

SEQ ID NO: 4205 - RNA, 19 nt, Artificial Sequence
  Description of Artificial Sequence: Synthetic oligonucleotide
ggauggcuuuugcucuaga

SEQ ID NO: 4206 - RNA, 19 nt, Artificial Sequence
  Description of Artificial Sequence: Synthetic oligonucleotide
ucuagagcaaaagccaucc

SEQ ID NO: 4207 - RNA, 19 nt, Artificial Sequence
  Description of Artificial Sequence: Synthetic oligonucleotide
gauggcuuuugcucuagaa

SEQ ID NO: 4208 - RNA, 19 nt, Artificial Sequence
  Description of Artificial Sequence: Synthetic oligonucleotide
uucuagagcaaaagccauc

SEQ ID NO: 4209 - RNA, 19 nt, Artificial Sequence
  Description of Artificial Sequence: Synthetic oligonucleotide
auggcuuuugcucuagaag

SEQ ID NO: 4210 - RNA, 19 nt, Artificial Sequence
  Description of Artificial Sequence: Synthetic oligonucleotide
cuucuagagcaaaagccau

SEQ ID NO: 4211 - RNA, 19 nt, Artificial Sequence
  Description of Artificial Sequence: Synthetic oligonucleotide
uggcuuuugcucuagaagu

SEQ ID NO: 4212 - RNA, 19 nt, Artificial Sequence
  Description of Artificial Sequence: Synthetic oligonucleotide
acuucuagagcaaaagcca

SEQ ID NO: 4213 - RNA, 19 nt, Artificial Sequence
  Description of Artificial Sequence: Synthetic oligonucleotide
ggcuuuugcucuagaaguc

SEQ ID NO: 4214 - RNA, 19 nt, Artificial Sequence
  Description of Artificial Sequence: Synthetic oligonucleotide
gacuucuagagcaaaagcc

SEQ ID NO: 4215 - RNA, 19 nt, Artificial Sequence
  Description of Artificial Sequence: Synthetic oligonucleotide
gcuuuugcucuagaaguca

SEQ ID NO: 4216 - RNA, 19 nt, Artificial Sequence
  Description of Artificial Sequence: Synthetic oligonucleotide
ugacuucuagagcaaaagc

SEQ ID NO: 4217 - RNA, 19 nt, Artificial Sequence
  Description of Artificial Sequence: Synthetic oligonucleotide
cuuuugcucuagaagucaa

SEQ ID NO: 4218 - RNA, 19 nt, Artificial Sequence
  Description of Artificial Sequence: Synthetic oligonucleotide
uugacuucuagagcaaaag

SEQ ID NO: 4219 - RNA, 19 nt, Artificial Sequence
  Description of Artificial Sequence: Synthetic oligonucleotide
uuuugcucuagaagucaac

SEQ ID NO: 4220 - RNA, 19 nt, Artificial Sequence
  Description of Artificial Sequence: Synthetic oligonucleotide
guugacuucuagagcaaaa

SEQ ID NO: 4221 - RNA, 19 nt, Artificial Sequence
  Description of Artificial Sequence: Synthetic oligonucleotide
uucaucuucauccucacau

SEQ ID NO: 4222 - RNA, 19 nt, Artificial Sequence
  Description of Artificial Sequence: Synthetic oligonucleotide
augugaggaugaagaugaa

SEQ ID NO: 4223 - RNA, 19 nt, Artificial Sequence
  Description of Artificial Sequence: Synthetic oligonucleotide
ucaucuucauccucacauu

SEQ ID NO: 4224 - RNA, 19 nt, Artificial Sequence
  Description of Artificial Sequence: Synthetic oligonucleotide
aaugugaggaugaagauga

SEQ ID NO: 4225 - RNA, 19 nt, Artificial Sequence
  Description of Artificial Sequence: Synthetic oligonucleotide
caucuucauccucacauug

SEQ ID NO: 4226 - RNA, 19 nt, Artificial Sequence
  Description of Artificial Sequence: Synthetic oligonucleotide
caaugugaggaugaagaug

SEQ ID NO: 4227 - RNA, 19 nt, Artificial Sequence
  Description of Artificial Sequence: Synthetic oligonucleotide
aucuucauccucacauugg

SEQ ID NO: 4228 - RNA, 19 nt, Artificial Sequence
  Description of Artificial Sequence: Synthetic oligonucleotide
ccaaugugaggaugaagau

SEQ ID NO: 4229 - RNA, 19 nt, Artificial Sequence
  Description of Artificial Sequence: Synthetic oligonucleotide
ucuucauccucacauuggc

SEQ ID NO: 4230 - RNA, 19 nt, Artificial Sequence
  Description of Artificial Sequence: Synthetic oligonucleotide
gccaaugugaggaugaaga

SEQ ID NO: 4231 - RNA, 19 nt, Artificial Sequence
  Description of Artificial Sequence: Synthetic oligonucleotide
cuucauccucacauuggca

SEQ ID NO: 4232 - RNA, 19 nt, Artificial Sequence
  Description of Artificial Sequence: Synthetic oligonucleotide
ugccaaugugaggaugaag

SEQ ID NO: 4233 - RNA, 19 nt, Artificial Sequence
  Description of Artificial Sequence: Synthetic oligonucleotide
uucauccucacauuggcau

SEQ ID NO: 4234 - RNA, 19 nt, Artificial Sequence
  Description of Artificial Sequence: Synthetic oligonucleotide
augccaaugugaggaugaa

SEQ ID NO: 4235 - RNA, 19 nt, Artificial Sequence
  Description of Artificial Sequence: Synthetic oligonucleotide
ucauccucacauuggcauc

SEQ ID NO: 4236 - RNA, 19 nt, Artificial Sequence
  Description of Artificial Sequence: Synthetic oligonucleotide
gaugccaaugugaggauga

SEQ ID NO: 4237 - RNA, 19 nt, Artificial Sequence
  Description of Artificial Sequence: Synthetic oligonucleotide
cauccucacauuggcauca

SEQ ID NO: 4238 - RNA, 19 nt, Artificial Sequence
  Description of Artificial Sequence: Synthetic oligonucleotide
ugaugccaaugugaggaug

SEQ ID NO: 4239 - RNA, 19 nt, Artificial Sequence
  Description of Artificial Sequence: Synthetic oligonucleotide
cccuaauaaccaucacagu

SEQ ID NO: 4240 - RNA, 19 nt, Artificial Sequence
  Description of Artificial Sequence: Synthetic oligonucleotide
acugugaugguuauuaggg

SEQ ID NO: 4241 - RNA, 19 nt, Artificial Sequence
  Description of Artificial Sequence: Synthetic oligonucleotide
ccuaauaaccaucacagug

SEQ ID NO: 4242 - RNA, 19 nt, Artificial Sequence
  Description of Artificial Sequence: Synthetic oligonucleotide
cacugugaugguuauuagg

SEQ ID NO: 4243 - RNA, 19 nt, Artificial Sequence
  Description of Artificial Sequence: Synthetic oligonucleotide
agcaagagcacuacaugaa

SEQ ID NO: 4244 - RNA, 19 nt, Artificial Sequence
  Description of Artificial Sequence: Synthetic oligonucleotide
uucauguagugcucuugcu

SEQ ID NO: 4245 - RNA, 19 nt, Artificial Sequence
  Description of Artificial Sequence: Synthetic oligonucleotide
gcaagagcacuacaugaag

SEQ ID NO: 4246 - RNA, 19 nt, Artificial Sequence
  Description of Artificial Sequence: Synthetic oligonucleotide
cuucauguagugcucuugc

SEQ ID NO: 4247 - RNA, 19 nt, Artificial Sequence
  Description of Artificial Sequence: Synthetic oligonucleotide
cacuacaugaagggcucug

SEQ ID NO: 4248 - RNA, 19 nt, Artificial Sequence
  Description of Artificial Sequence: Synthetic oligonucleotide
cagagcccuucauguagug

SEQ ID NO: 4249 - RNA, 19 nt, Artificial Sequence
  Description of Artificial Sequence: Synthetic oligonucleotide
acuacaugaagggcucuga

SEQ ID NO: 4250 - RNA, 19 nt, Artificial Sequence
  Description of Artificial Sequence: Synthetic oligonucleotide
ucagagcccuucauguagu

SEQ ID NO: 4251 - RNA, 19 nt, Artificial Sequence
  Description of Artificial Sequence: Synthetic oligonucleotide
cuacaugaagggcucugac

SEQ ID NO: 4252 - RNA, 19 nt, Artificial Sequence
  Description of Artificial Sequence: Synthetic oligonucleotide
gucagagcccuucauguag

SEQ ID NO: 4253 - RNA, 19 nt, Artificial Sequence
  Description of Artificial Sequence: Synthetic oligonucleotide
uacaugaagggcucugacg

SEQ ID NO: 4254 - RNA, 19 nt, Artificial Sequence
  Description of Artificial Sequence: Synthetic oligonucleotide
cgucagagcccuucaugua

SEQ ID NO: 4255 - RNA, 19 nt, Artificial Sequence
  Description of Artificial Sequence: Synthetic oligonucleotide
acaugaagggcucugacgg

SEQ ID NO: 4256 - RNA, 19 nt, Artificial Sequence
  Description of Artificial Sequence: Synthetic oligonucleotide
ccgucagagcccuucaugu

SEQ ID NO: 4257 - RNA, 19 nt, Artificial Sequence
  Description of Artificial Sequence: Synthetic oligonucleotide
caugaagggcucugacggc

SEQ ID NO: 4258 - RNA, 19 nt, Artificial Sequence
  Description of Artificial Sequence: Synthetic oligonucleotide
gccgucagagcccuucaug

SEQ ID NO: 4259 - RNA, 19 nt, Artificial Sequence
  Description of Artificial Sequence: Synthetic oligonucleotide
augaagggcucugacggcg

SEQ ID NO: 4260 - RNA, 19 nt, Artificial Sequence
  Description of Artificial Sequence: Synthetic oligonucleotide
cgccgucagagcccuucau

SEQ ID NO: 4261 - RNA, 19 nt, Artificial Sequence
  Description of Artificial Sequence: Synthetic oligonucleotide
ccggacacuggguaccugu

SEQ ID NO: 4262 - RNA, 19 nt, Artificial Sequence
  Description of Artificial Sequence: Synthetic oligonucleotide
acagguacccaguguccgg

SEQ ID NO: 4263 - RNA, 19 nt, Artificial Sequence
  Description of Artificial Sequence: Synthetic oligonucleotide
cggacacuggguaccugug

SEQ ID NO: 4264 - RNA, 19 nt, Artificial Sequence
  Description of Artificial Sequence: Synthetic oligonucleotide
cacagguacccaguguccg

SEQ ID NO: 4265 - RNA, 19 nt, Artificial Sequence
  Description of Artificial Sequence: Synthetic oligonucleotide
ggacacuggguaccugugg

SEQ ID NO: 4266 - RNA, 19 nt, Artificial Sequence
  Description of Artificial Sequence: Synthetic oligonucleotide
ccacagguacccagugucc

SEQ ID NO: 4267 - RNA, 19 nt, Artificial Sequence
  Description of Artificial Sequence: Synthetic oligonucleotide
gacacuggguaccuguggc

SEQ ID NO: 4268 - RNA, 19 nt, Artificial Sequence
  Description of Artificial Sequence: Synthetic oligonucleotide
gccacagguacccaguguc

SEQ ID NO: 4269 - RNA, 19 nt, Artificial Sequence
  Description of Artificial Sequence: Synthetic oligonucleotide
acacuggguaccuguggca

SEQ ID NO: 4270 - RNA, 19 nt, Artificial Sequence
  Description of Artificial Sequence: Synthetic oligonucleotide
ugccacagguacccagugu

SEQ ID NO: 4271 - RNA, 19 nt, Artificial Sequence
  Description of Artificial Sequence: Synthetic oligonucleotide
cacuggguaccuguggcau

SEQ ID NO: 4272 - RNA, 19 nt, Artificial Sequence
  Description of Artificial Sequence: Synthetic oligonucleotide
augccacagguacccagug

SEQ ID NO: 4273 - RNA, 19 nt, Artificial Sequence
  Description of Artificial Sequence: Synthetic oligonucleotide
acuggguaccuguggcaug

SEQ ID NO: 4274 - RNA, 19 nt, Artificial Sequence
  Description of Artificial Sequence: Synthetic oligonucleotide
caugccacagguacccagu

SEQ ID NO: 4275 - RNA, 19 nt, Artificial Sequence
  Description of Artificial Sequence: Synthetic oligonucleotide
cuggguaccuguggcaugu

SEQ ID NO: 4276 - RNA, 19 nt, Artificial Sequence
  Description of Artificial Sequence: Synthetic oligonucleotide
acaugccacagguacccag

SEQ ID NO: 4277 - RNA, 19 nt, Artificial Sequence
  Description of Artificial Sequence: Synthetic oligonucleotide
uggguaccuguggcauguu

SEQ ID NO: 4278 - RNA, 19 nt, Artificial Sequence
  Description of Artificial Sequence: Synthetic oligonucleotide
aacaugccacagguaccca

SEQ ID NO: 4279 - RNA, 19 nt, Artificial Sequence
  Description of Artificial Sequence: Synthetic oligonucleotide
ggguaccuguggcauguuc

SEQ ID NO: 4280 - RNA, 19 nt, Artificial Sequence
  Description of Artificial Sequence: Synthetic oligonucleotide
gaacaugccacagguaccc

SEQ ID NO: 4281 - RNA, 19 nt, Artificial Sequence
  Description of Artificial Sequence: Synthetic oligonucleotide
gguaccuguggcauguucc

SEQ ID NO: 4282 - RNA, 19 nt, Artificial Sequence
  Description of Artificial Sequence: Synthetic oligonucleotide
ggaacaugccacagguacc

SEQ ID NO: 4283 - RNA, 19 nt, Artificial Sequence
  Description of Artificial Sequence: Synthetic oligonucleotide
guaccuguggcauguucca

SEQ ID NO: 4284 - RNA, 19 nt, Artificial Sequence
  Description of Artificial Sequence: Synthetic oligonucleotide
uggaacaugccacagguac

SEQ ID NO: 4285 - RNA, 19 nt, Artificial Sequence
  Description of Artificial Sequence: Synthetic oligonucleotide
uaccuguggcauguuccau

SEQ ID NO: 4286 - RNA, 19 nt, Artificial Sequence
  Description of Artificial Sequence: Synthetic oligonucleotide
auggaacaugccacaggua

SEQ ID NO: 4287 - RNA, 19 nt, Artificial Sequence
  Description of Artificial Sequence: Synthetic oligonucleotide
accuguggcauguuccauu

SEQ ID NO: 4288 - RNA, 19 nt, Artificial Sequence
  Description of Artificial Sequence: Synthetic oligonucleotide
aauggaacaugccacaggu

SEQ ID NO: 4289 - RNA, 19 nt, Artificial Sequence
  Description of Artificial Sequence: Synthetic oligonucleotide
ccuguggcauguuccauug

SEQ ID NO: 4290 - RNA, 19 nt, Artificial Sequence
  Description of Artificial Sequence: Synthetic oligonucleotide
caauggaacaugccacagg

SEQ ID NO: 4291 - RNA, 19 nt, Artificial Sequence
  Description of Artificial Sequence: Synthetic oligonucleotide
cuguggcauguuccauuga

SEQ ID NO: 4292 - RNA, 19 nt, Artificial Sequence
  Description of Artificial Sequence: Synthetic oligonucleotide
ucaauggaacaugccacag

SEQ ID NO: 4293 - RNA, 19 nt, Artificial Sequence
  Description of Artificial Sequence: Synthetic oligonucleotide
uguggcauguuccauugac

SEQ ID NO: 4294 - RNA, 19 nt, Artificial Sequence
  Description of Artificial Sequence: Synthetic oligonucleotide
gucaauggaacaugccaca

SEQ ID NO: 4295 - RNA, 19 nt, Artificial Sequence
  Description of Artificial Sequence: Synthetic oligonucleotide
guggcauguuccauugaca

SEQ ID NO: 4296 - RNA, 19 nt, Artificial Sequence
  Description of Artificial Sequence: Synthetic oligonucleotide
ugucaauggaacaugccac

SEQ ID NO: 4297 - RNA, 19 nt, Artificial Sequence
  Description of Artificial Sequence: Synthetic oligonucleotide
uguuccauugacauucauc

SEQ ID NO: 4298 - RNA, 19 nt, Artificial Sequence
  Description of Artificial Sequence: Synthetic oligonucleotide
gaugaaugucaauggaaca

SEQ ID NO: 4299 - RNA, 19 nt, Artificial Sequence
  Description of Artificial Sequence: Synthetic oligonucleotide
uccauugacauucaucacc

SEQ ID NO: 4300 - RNA, 19 nt, Artificial Sequence
  Description of Artificial Sequence: Synthetic oligonucleotide
ggugaugaaugucaaugga

SEQ ID NO: 4301 - RNA, 19 nt, Artificial Sequence
  Description of Artificial Sequence: Synthetic oligonucleotide
cauugacauucaucaccag

SEQ ID NO: 4302 - RNA, 19 nt, Artificial Sequence
  Description of Artificial Sequence: Synthetic oligonucleotide
cuggugaugaaugucaaug

SEQ ID NO: 4303 - RNA, 19 nt, Artificial Sequence
  Description of Artificial Sequence: Synthetic oligonucleotide
acauucaucaccagcaaau

SEQ ID NO: 4304 - RNA, 19 nt, Artificial Sequence
  Description of Artificial Sequence: Synthetic oligonucleotide
auuugcuggugaugaaugu

SEQ ID NO: 4305 - RNA, 19 nt, Artificial Sequence
  Description of Artificial Sequence: Synthetic oligonucleotide
cucccagaagagguggaau

SEQ ID NO: 4306 - RNA, 19 nt, Artificial Sequence
  Description of Artificial Sequence: Synthetic oligonucleotide
auuccaccucuucugggag

SEQ ID NO: 4307 - RNA, 19 nt, Artificial Sequence
  Description of Artificial Sequence: Synthetic oligonucleotide
ucccagaagagguggaaug

SEQ ID NO: 4308 - RNA, 19 nt, Artificial Sequence
  Description of Artificial Sequence: Synthetic oligonucleotide
cauuccaccucuucuggga

SEQ ID NO: 4309 - RNA, 19 nt, Artificial Sequence
  Description of Artificial Sequence: Synthetic oligonucleotide
cccagaagagguggaaugg

SEQ ID NO: 4310 - RNA, 19 nt, Artificial Sequence
  Description of Artificial Sequence: Synthetic oligonucleotide
ccauuccaccucuucuggg

SEQ ID NO: 4311 - RNA, 19 nt, Artificial Sequence
  Description of Artificial Sequence: Synthetic oligonucleotide
ccagaagagguggaaugga

SEQ ID NO: 4312 - RNA, 19 nt, Artificial Sequence
  Description of Artificial Sequence: Synthetic oligonucleotide
uccauuccaccucuucugg

SEQ ID NO: 4313 - RNA, 19 nt, Artificial Sequence
  Description of Artificial Sequence: Synthetic oligonucleotide
cagaagagguggaauggau

SEQ ID NO: 4314 - RNA, 19 nt, Artificial Sequence
  Description of Artificial Sequence: Synthetic oligonucleotide
auccauuccaccucuucug

SEQ ID NO: 4315 - RNA, 19 nt, Artificial Sequence
  Description of Artificial Sequence: Synthetic oligonucleotide
agaagagguggaauggauc

SEQ ID NO: 4316 - RNA, 19 nt, Artificial Sequence
  Description of Artificial Sequence: Synthetic oligonucleotide
gauccauuccaccucuucu

SEQ ID NO: 4317 - RNA, 19 nt, Artificial Sequence
  Description of Artificial Sequence: Synthetic oligonucleotide
gaagagguggaauggauca

SEQ ID NO: 4318 - RNA, 19 nt, Artificial Sequence
  Description of Artificial Sequence: Synthetic oligonucleotide
ugauccauuccaccucuuc

SEQ ID NO: 4319 - RNA, 19 nt, Artificial Sequence
  Description of Artificial Sequence: Synthetic oligonucleotide
gagguggaauggaucaaau

SEQ ID NO: 4320 - RNA, 19 nt, Artificial Sequence
  Description of Artificial Sequence: Synthetic oligonucleotide
auuugauccauuccaccuc

SEQ ID NO: 4321 - RNA, 19 nt, Artificial Sequence
  Description of Artificial Sequence: Synthetic oligonucleotide
agguggaauggaucaaauu

SEQ ID NO: 4322 - RNA, 19 nt, Artificial Sequence
  Description of Artificial Sequence: Synthetic oligonucleotide
aauuugauccauuccaccu

SEQ ID NO: 4323 - RNA, 19 nt, Artificial Sequence
  Description of Artificial Sequence: Synthetic oligonucleotide
gguggaauggaucaaauuu

SEQ ID NO: 4324 - RNA, 19 nt, Artificial Sequence
  Description of Artificial Sequence: Synthetic oligonucleotide
aaauuugauccauuccacc

SEQ ID NO: 4325 - RNA, 19 nt, Artificial Sequence
  Description of Artificial Sequence: Synthetic oligonucleotide
guggaauggaucaaauuua

SEQ ID NO: 4326 - RNA, 19 nt, Artificial Sequence
  Description of Artificial Sequence: Synthetic oligonucleotide
uaaauuugauccauuccac

SEQ ID NO: 4327 - RNA, 19 nt, Artificial Sequence
  Description of Artificial Sequence: Synthetic oligonucleotide
gaucaaauuuaaugugggc

SEQ ID NO: 4328 - RNA, 19 nt, Artificial Sequence
  Description of Artificial Sequence: Synthetic oligonucleotide
gcccacauuaaauuugauc

SEQ ID NO: 4329 - RNA, 19 nt, Artificial Sequence
  Description of Artificial Sequence: Synthetic oligonucleotide
aucaaauuuaaugugggca

SEQ ID NO: 4330 - RNA, 19 nt, Artificial Sequence
  Description of Artificial Sequence: Synthetic oligonucleotide
ugcccacauuaaauuugau

SEQ ID NO: 4331 - RNA, 19 nt, Artificial Sequence
  Description of Artificial Sequence: Synthetic oligonucleotide
ucaaauuuaaugugggcau

SEQ ID NO: 4332 - RNA, 19 nt, Artificial Sequence
  Description of Artificial Sequence: Synthetic oligonucleotide
augcccacauuaaauuuga

SEQ ID NO: 4333 - RNA, 19 nt, Artificial Sequence
  Description of Artificial Sequence: Synthetic oligonucleotide
caaauuuaaugugggcaug

SEQ ID NO: 4334 - RNA, 19 nt, Artificial Sequence
  Description of Artificial Sequence: Synthetic oligonucleotide
caugcccacauuaaauuug

SEQ ID NO: 4335 - RNA, 19 nt, Artificial Sequence
  Description of Artificial Sequence: Synthetic oligonucleotide
aaauuuaaugugggcauga

SEQ ID NO: 4336 - RNA, 19 nt, Artificial Sequence
  Description of Artificial Sequence: Synthetic oligonucleotide
ucaugcccacauuaaauuu

SEQ ID NO: 4337 - RNA, 19 nt, Artificial Sequence
  Description of Artificial Sequence: Synthetic oligonucleotide
aauuuaaugugggcaugaa

SEQ ID NO: 4338 - RNA, 19 nt, Artificial Sequence
  Description of Artificial Sequence: Synthetic oligonucleotide
uucaugcccacauuaaauu

SEQ ID NO: 4339 - RNA, 19 nt, Artificial Sequence
  Description of Artificial Sequence: Synthetic oligonucleotide
uaaugugggcaugaauggc

SEQ ID NO: 4340 - RNA, 19 nt, Artificial Sequence
  Description of Artificial Sequence: Synthetic oligonucleotide
gccauucaugcccacauua

SEQ ID NO: 4341 - RNA, 19 nt, Artificial Sequence
  Description of Artificial Sequence: Synthetic oligonucleotide
aaugugggcaugaauggcu

SEQ ID NO: 4342 - RNA, 19 nt, Artificial Sequence
  Description of Artificial Sequence: Synthetic oligonucleotide
agccauucaugcccacauu

SEQ ID NO: 4343 - RNA, 19 nt, Artificial Sequence
  Description of Artificial Sequence: Synthetic oligonucleotide
augugggcaugaauggcua

SEQ ID NO: 4344 - RNA, 19 nt, Artificial Sequence
  Description of Artificial Sequence: Synthetic oligonucleotide
uagccauucaugcccacau

SEQ ID NO: 4345 - RNA, 19 nt, Artificial Sequence
  Description of Artificial Sequence: Synthetic oligonucleotide
ugugggcaugaauggcuau

SEQ ID NO: 4346 - RNA, 19 nt, Artificial Sequence
  Description of Artificial Sequence: Synthetic oligonucleotide
auagccauucaugcccaca

SEQ ID NO: 4347 - RNA, 19 nt, Artificial Sequence
  Description of Artificial Sequence: Synthetic oligonucleotide
gugggcaugaauggcuauu

SEQ ID NO: 4348 - RNA, 19 nt, Artificial Sequence
  Description of Artificial Sequence: Synthetic oligonucleotide
aauagccauucaugcccac

SEQ ID NO: 4349 - RNA, 19 nt, Artificial Sequence
  Description of Artificial Sequence: Synthetic oligonucleotide
ugggcaugaauggcuauua

SEQ ID NO: 4350 - RNA, 19 nt, Artificial Sequence
  Description of Artificial Sequence: Synthetic oligonucleotide
uaauagccauucaugccca

SEQ ID NO: 4351 - RNA, 19 nt, Artificial Sequence
  Description of Artificial Sequence: Synthetic oligonucleotide
gggcaugaauggcuauuac

SEQ ID NO: 4352 - RNA, 19 nt, Artificial Sequence
  Description of Artificial Sequence: Synthetic oligonucleotide
guaauagccauucaugccc

SEQ ID NO: 4353 - RNA, 19 nt, Artificial Sequence
  Description of Artificial Sequence: Synthetic oligonucleotide
ggcaugaauggcuauuaca

SEQ ID NO: 4354 - RNA, 19 nt, Artificial Sequence
  Description of Artificial Sequence: Synthetic oligonucleotide
uguaauagccauucaugcc

SEQ ID NO: 4355 - RNA, 19 nt, Artificial Sequence
  Description of Artificial Sequence: Synthetic oligonucleotide
auggcuauuacauugugca

SEQ ID NO: 4356 - RNA, 19 nt, Artificial Sequence
  Description of Artificial Sequence: Synthetic oligonucleotide
ugcacaauguaauagccau

SEQ ID NO: 4357 - RNA, 19 nt, Artificial Sequence
  Description of Artificial Sequence: Synthetic oligonucleotide
auuacauugugcauuacga

SEQ ID NO: 4358 - RNA, 19 nt, Artificial Sequence
  Description of Artificial Sequence: Synthetic oligonucleotide
ucguaaugcacaauguaau

SEQ ID NO: 4359 - RNA, 19 nt, Artificial Sequence
  Description of Artificial Sequence: Synthetic oligonucleotide
uuacauugugcauuacgag

SEQ ID NO: 4360 - RNA, 19 nt, Artificial Sequence
  Description of Artificial Sequence: Synthetic oligonucleotide
cucguaaugcacaauguaa

SEQ ID NO: 4361 - RNA, 19 nt, Artificial Sequence
  Description of Artificial Sequence: Synthetic oligonucleotide
uacauugugcauuacgagg

SEQ ID NO: 4362 - RNA, 19 nt, Artificial Sequence
  Description of Artificial Sequence: Synthetic oligonucleotide
ccucguaaugcacaaugua

SEQ ID NO: 4363 - RNA, 19 nt, Artificial Sequence
  Description of Artificial Sequence: Synthetic oligonucleotide
acauugugcauuacgagga

SEQ ID NO: 4364 - RNA, 19 nt, Artificial Sequence
  Description of Artificial Sequence: Synthetic oligonucleotide
uccucguaaugcacaaugu

SEQ ID NO: 4365 - RNA, 19 nt, Artificial Sequence
  Description of Artificial Sequence: Synthetic oligonucleotide
cauugugcauuacgaggau

SEQ ID NO: 4366 - RNA, 19 nt, Artificial Sequence
  Description of Artificial Sequence: Synthetic oligonucleotide
auccucguaaugcacaaug

SEQ ID NO: 4367 - RNA, 19 nt, Artificial Sequence
  Description of Artificial Sequence: Synthetic oligonucleotide
auugugcauuacgaggaug

SEQ ID NO: 4368 - RNA, 19 nt, Artificial Sequence
  Description of Artificial Sequence: Synthetic oligonucleotide
cauccucguaaugcacaau

SEQ ID NO: 4369 - RNA, 19 nt, Artificial Sequence
  Description of Artificial Sequence: Synthetic oligonucleotide
uugugcauuacgaggauga

SEQ ID NO: 4370 - RNA, 19 nt, Artificial Sequence
  Description of Artificial Sequence: Synthetic oligonucleotide
ucauccucguaaugcacaa

SEQ ID NO: 4371 - RNA, 19 nt, Artificial Sequence
  Description of Artificial Sequence: Synthetic oligonucleotide
ugugcauuacgaggaugau

SEQ ID NO: 4372 - RNA, 19 nt, Artificial Sequence
  Description of Artificial Sequence: Synthetic oligonucleotide
aucauccucguaaugcaca

SEQ ID NO: 4373 - RNA, 19 nt, Artificial Sequence
  Description of Artificial Sequence: Synthetic oligonucleotide
gugcauuacgaggaugaug

SEQ ID NO: 4374 - RNA, 19 nt, Artificial Sequence
  Description of Artificial Sequence: Synthetic oligonucleotide
caucauccucguaaugcac

SEQ ID NO: 4375 - RNA, 19 nt, Artificial Sequence
  Description of Artificial Sequence: Synthetic oligonucleotide
ugcauuacgaggaugaugg

SEQ ID NO: 4376 - RNA, 19 nt, Artificial Sequence
  Description of Artificial Sequence: Synthetic oligonucleotide
ccaucauccucguaaugca

SEQ ID NO: 4377 - RNA, 19 nt, Artificial Sequence
  Description of Artificial Sequence: Synthetic oligonucleotide
gcauuacgaggaugaugga

SEQ ID NO: 4378 - RNA, 19 nt, Artificial Sequence
  Description of Artificial Sequence: Synthetic oligonucleotide
uccaucauccucguaaugc

SEQ ID NO: 4379 - RNA, 19 nt, Artificial Sequence
  Description of Artificial Sequence: Synthetic oligonucleotide
cauuacgaggaugauggau

SEQ ID NO: 4380 - RNA, 19 nt, Artificial Sequence
  Description of Artificial Sequence: Synthetic oligonucleotide
auccaucauccucguaaug

SEQ ID NO: 4381 - RNA, 19 nt, Artificial Sequence
  Description of Artificial Sequence: Synthetic oligonucleotide
auuacgaggaugauggaug

SEQ ID NO: 4382 - RNA, 19 nt, Artificial Sequence
  Description of Artificial Sequence: Synthetic oligonucleotide
cauccaucauccucguaau

SEQ ID NO: 4383 - RNA, 19 nt, Artificial Sequence
  Description of Artificial Sequence: Synthetic oligonucleotide
uuacgaggaugauggaugg

SEQ ID NO: 4384 - RNA, 19 nt, Artificial Sequence
  Description of Artificial Sequence: Synthetic oligonucleotide
ccauccaucauccucguaa

SEQ ID NO: 4385 - RNA, 19 nt, Artificial Sequence
  Description of Artificial Sequence: Synthetic oligonucleotide
uacgaggaugauggauggg

SEQ ID NO: 4386 - RNA, 19 nt, Artificial Sequence
  Description of Artificial Sequence: Synthetic oligonucleotide
cccauccaucauccucgua

SEQ ID NO: 4387 - RNA, 19 nt, Artificial Sequence
  Description of Artificial Sequence: Synthetic oligonucleotide
acgaggaugauggauggga

SEQ ID NO: 4388 - RNA, 19 nt, Artificial Sequence
  Description of Artificial Sequence: Synthetic oligonucleotide
ucccauccaucauccucgu

SEQ ID NO: 4389 - RNA, 19 nt, Artificial Sequence
  Description of Artificial Sequence: Synthetic oligonucleotide
cgaggaugauggaugggac

SEQ ID NO: 4390 - RNA, 19 nt, Artificial Sequence
  Description of Artificial Sequence: Synthetic oligonucleotide
gucccauccaucauccucg

SEQ ID NO: 4391 - RNA, 19 nt, Artificial Sequence
  Description of Artificial Sequence: Synthetic oligonucleotide
gaggaugauggaugggacu

SEQ ID NO: 4392 - RNA, 19 nt, Artificial Sequence
  Description of Artificial Sequence: Synthetic oligonucleotide
agucccauccaucauccuc

SEQ ID NO: 4393 - RNA, 19 nt, Artificial Sequence
  Description of Artificial Sequence: Synthetic oligonucleotide
aggaugauggaugggacuc

SEQ ID NO: 4394 - RNA, 19 nt, Artificial Sequence
  Description of Artificial Sequence: Synthetic oligonucleotide
gagucccauccaucauccu

SEQ ID NO: 4395 - RNA, 19 nt, Artificial Sequence
  Description of Artificial Sequence: Synthetic oligonucleotide
ggaugauggaugggacucu

SEQ ID NO: 4396 - RNA, 19 nt, Artificial Sequence
  Description of Artificial Sequence: Synthetic oligonucleotide
agagucccauccaucaucc

SEQ ID NO: 4397 - RNA, 19 nt, Artificial Sequence
  Description of Artificial Sequence: Synthetic oligonucleotide
gaugauggaugggacucuu

SEQ ID NO: 4398 - RNA, 19 nt, Artificial Sequence
  Description of Artificial Sequence: Synthetic oligonucleotide
aagagucccauccaucauc

SEQ ID NO: 4399 - RNA, 19 nt, Artificial Sequence
  Description of Artificial Sequence: Synthetic oligonucleotide
augauggaugggacucuuu

SEQ ID NO: 4400 - RNA, 19 nt, Artificial Sequence
  Description of Artificial Sequence: Synthetic oligonucleotide
aaagagucccauccaucau

SEQ ID NO: 4401 - RNA, 19 nt, Artificial Sequence
  Description of Artificial Sequence: Synthetic oligonucleotide
ugauggaugggacucuuug

SEQ ID NO: 4402 - RNA, 19 nt, Artificial Sequence
  Description of Artificial Sequence: Synthetic oligonucleotide
caaagagucccauccauca

SEQ ID NO: 4403 - RNA, 19 nt, Artificial Sequence
  Description of Artificial Sequence: Synthetic oligonucleotide
gauggaugggacucuuuga

SEQ ID NO: 4404 - RNA, 19 nt, Artificial Sequence
  Description of Artificial Sequence: Synthetic oligonucleotide
ucaaagagucccauccauc

SEQ ID NO: 4405 - RNA, 19 nt, Artificial Sequence
  Description of Artificial Sequence: Synthetic oligonucleotide
auggaugggacucuuugac

SEQ ID NO: 4406 - RNA, 19 nt, Artificial Sequence
  Description of Artificial Sequence: Synthetic oligonucleotide
gucaaagagucccauccau

SEQ ID NO: 4407 - RNA, 19 nt, Artificial Sequence
  Description of Artificial Sequence: Synthetic oligonucleotide
uggaugggacucuuugacu

SEQ ID NO: 4408 - RNA, 19 nt, Artificial Sequence
  Description of Artificial Sequence: Synthetic oligonucleotide
agucaaagagucccaucca

SEQ ID NO: 4409 - RNA, 19 nt, Artificial Sequence
  Description of Artificial Sequence: Synthetic oligonucleotide
ggaugggacucuuugacug

SEQ ID NO: 4410 - RNA, 19 nt, Artificial Sequence
  Description of Artificial Sequence: Synthetic oligonucleotide
cagucaaagagucccaucc

SEQ ID NO: 4411 - RNA, 19 nt, Artificial Sequence
  Description of Artificial Sequence: Synthetic oligonucleotide
gaugggacucuuugacugg

SEQ ID NO: 4412 - RNA, 19 nt, Artificial Sequence
  Description of Artificial Sequence: Synthetic oligonucleotide
ccagucaaagagucccauc

SEQ ID NO: 4413 - RNA, 19 nt, Artificial Sequence
  Description of Artificial Sequence: Synthetic oligonucleotide
augggacucuuugacuggc

SEQ ID NO: 4414 - RNA, 19 nt, Artificial Sequence
  Description of Artificial Sequence: Synthetic oligonucleotide
gccagucaaagagucccau

SEQ ID NO: 4415 - RNA, 19 nt, Artificial Sequence
  Description of Artificial Sequence: Synthetic oligonucleotide
ugggacucuuugacuggcc

SEQ ID NO: 4416 - RNA, 19 nt, Artificial Sequence
  Description of Artificial Sequence: Synthetic oligonucleotide
ggccagucaaagaguccca

SEQ ID NO: 4417 - RNA, 19 nt, Artificial Sequence
  Description of Artificial Sequence: Synthetic oligonucleotide
gggacucuuugacuggccu

SEQ ID NO: 4418 - RNA, 19 nt, Artificial Sequence
  Description of Artificial Sequence: Synthetic oligonucleotide
aggccagucaaagaguccc

SEQ ID NO: 4419 - RNA, 19 nt, Artificial Sequence
  Description of Artificial Sequence: Synthetic oligonucleotide
ggacucuuugacuggccuu

SEQ ID NO: 4420 - RNA, 19 nt, Artificial Sequence
  Description of Artificial Sequence: Synthetic oligonucleotide
aaggccagucaaagagucc

SEQ ID NO: 4421 - RNA, 19 nt, Artificial Sequence
  Description of Artificial Sequence: Synthetic oligonucleotide
gacucuuugacuggccuuu

SEQ ID NO: 4422 - RNA, 19 nt, Artificial Sequence
  Description of Artificial Sequence: Synthetic oligonucleotide
aaaggccagucaaagaguc

SEQ ID NO: 4423 - RNA, 19 nt, Artificial Sequence
  Description of Artificial Sequence: Synthetic oligonucleotide
acucuuugacuggccuuuu

SEQ ID NO: 4424 - RNA, 19 nt, Artificial Sequence
  Description of Artificial Sequence: Synthetic oligonucleotide
aaaaggccagucaaagagu

SEQ ID NO: 4425 - RNA, 19 nt, Artificial Sequence
  Description of Artificial Sequence: Synthetic oligonucleotide
cucuuugacuggccuuuua

SEQ ID NO: 4426 - RNA, 19 nt, Artificial Sequence
  Description of Artificial Sequence: Synthetic oligonucleotide
uaaaaggccagucaaagag

SEQ ID NO: 4427 - RNA, 19 nt, Artificial Sequence
  Description of Artificial Sequence: Synthetic oligonucleotide
ucuuugacuggccuuuuaa

SEQ ID NO: 4428 - RNA, 19 nt, Artificial Sequence
  Description of Artificial Sequence: Synthetic oligonucleotide
uuaaaaggccagucaaaga

SEQ ID NO: 4429 - RNA, 19 nt, Artificial Sequence
  Description of Artificial Sequence: Synthetic oligonucleotide
cuuugacuggccuuuuaaa

SEQ ID NO: 4430 - RNA, 19 nt, Artificial Sequence
  Description of Artificial Sequence: Synthetic oligonucleotide
uuuaaaaggccagucaaag

SEQ ID NO: 4431 - RNA, 19 nt, Artificial Sequence
  Description of Artificial Sequence: Synthetic oligonucleotide
uuugacuggccuuuuaaaa

SEQ ID NO: 4432 - RNA, 19 nt, Artificial Sequence
  Description of Artificial Sequence: Synthetic oligonucleotide
uuuuaaaaggccagucaaa

SEQ ID NO: 4433 - RNA, 19 nt, Artificial Sequence
  Description of Artificial Sequence: Synthetic oligonucleotide
uugacuggccuuuuaaaag

SEQ ID NO: 4434 - RNA, 19 nt, Artificial Sequence
  Description of Artificial Sequence: Synthetic oligonucleotide
cuuuuaaaaggccagucaa

SEQ ID NO: 4435 - RNA, 19 nt, Artificial Sequence
  Description of Artificial Sequence: Synthetic oligonucleotide
cacagcagucagcaguaau

SEQ ID NO: 4436 - RNA, 19 nt, Artificial Sequence
  Description of Artificial Sequence: Synthetic oligonucleotide
auuacugcugacugcugug

SEQ ID NO: 4437 - RNA, 19 nt, Artificial Sequence
  Description of Artificial Sequence: Synthetic oligonucleotide
acagcagucagcaguaaug

SEQ ID NO: 4438 - RNA, 19 nt, Artificial Sequence
  Description of Artificial Sequence: Synthetic oligonucleotide
cauuacugcugacugcugu

SEQ ID NO: 4439 - RNA, 19 nt, Artificial Sequence
  Description of Artificial Sequence: Synthetic oligonucleotide
cagcagucagcaguaauga

SEQ ID NO: 4440 - RNA, 19 nt, Artificial Sequence
  Description of Artificial Sequence: Synthetic oligonucleotide
ucauuacugcugacugcug

SEQ ID NO: 4441 - RNA, 19 nt, Artificial Sequence
  Description of Artificial Sequence: Synthetic oligonucleotide
agcagucagcaguaaugau

SEQ ID NO: 4442 - RNA, 19 nt, Artificial Sequence
  Description of Artificial Sequence: Synthetic oligonucleotide
aucauuacugcugacugcu

SEQ ID NO: 4443 - RNA, 19 nt, Artificial Sequence
  Description of Artificial Sequence: Synthetic oligonucleotide
gcagucagcaguaaugauc

SEQ ID NO: 4444 - RNA, 19 nt, Artificial Sequence
  Description of Artificial Sequence: Synthetic oligonucleotide
gaucauuacugcugacugc

SEQ ID NO: 4445 - RNA, 19 nt, Artificial Sequence
  Description of Artificial Sequence: Synthetic oligonucleotide
cagucagcaguaaugaucg

SEQ ID NO: 4446 - RNA, 19 nt, Artificial Sequence
  Description of Artificial Sequence: Synthetic oligonucleotide
cgaucauuacugcugacug

SEQ ID NO: 4447 - RNA, 19 nt, Artificial Sequence
  Description of Artificial Sequence: Synthetic oligonucleotide
agucagcaguaaugaucgg

SEQ ID NO: 4448 - RNA, 19 nt, Artificial Sequence
  Description of Artificial Sequence: Synthetic oligonucleotide
ccgaucauuacugcugacu

SEQ ID NO: 4449 - RNA, 19 nt, Artificial Sequence
  Description of Artificial Sequence: Synthetic oligonucleotide
gucagcaguaaugaucggg

SEQ ID NO: 4450 - RNA, 19 nt, Artificial Sequence
  Description of Artificial Sequence: Synthetic oligonucleotide
cccgaucauuacugcugac

SEQ ID NO: 4451 - RNA, 19 nt, Artificial Sequence
  Description of Artificial Sequence: Synthetic oligonucleotide
ucagcaguaaugaucgggc

SEQ ID NO: 4452 - RNA, 19 nt, Artificial Sequence
  Description of Artificial Sequence: Synthetic oligonucleotide
gcccgaucauuacugcuga

SEQ ID NO: 4453 - RNA, 19 nt, Artificial Sequence
  Description of Artificial Sequence: Synthetic oligonucleotide
agcauugggaagcugucca

SEQ ID NO: 4454 - RNA, 19 nt, Artificial Sequence
  Description of Artificial Sequence: Synthetic oligonucleotide
uggacagcuucccaaugcu

SEQ ID NO: 4455 - RNA, 19 nt, Artificial Sequence
  Description of Artificial Sequence: Synthetic oligonucleotide
gcauugggaagcuguccau

SEQ ID NO: 4456 - RNA, 19 nt, Artificial Sequence
  Description of Artificial Sequence: Synthetic oligonucleotide
auggacagcuucccaaugc

SEQ ID NO: 4457 - RNA, 19 nt, Artificial Sequence
  Description of Artificial Sequence: Synthetic oligonucleotide
cauugggaagcuguccauu

SEQ ID NO: 4458 - RNA, 19 nt, Artificial Sequence
  Description of Artificial Sequence: Synthetic oligonucleotide
aauggacagcuucccaaug

SEQ ID NO: 4459 - RNA, 19 nt, Artificial Sequence
  Description of Artificial Sequence: Synthetic oligonucleotide
auugggaagcuguccauug

SEQ ID NO: 4460 - RNA, 19 nt, Artificial Sequence
  Description of Artificial Sequence: Synthetic oligonucleotide
caauggacagcuucccaau

SEQ ID NO: 4461 - RNA, 19 nt, Artificial Sequence
  Description of Artificial Sequence: Synthetic oligonucleotide
uugggaagcuguccauuga

SEQ ID NO: 4462 - RNA, 19 nt, Artificial Sequence
  Description of Artificial Sequence: Synthetic oligonucleotide
ucaauggacagcuucccaa

SEQ ID NO: 4463 - RNA, 19 nt, Artificial Sequence
  Description of Artificial Sequence: Synthetic oligonucleotide
ugggaagcuguccauugaa

SEQ ID NO: 4464 - RNA, 19 nt, Artificial Sequence
  Description of Artificial Sequence: Synthetic oligonucleotide
uucaauggacagcuuccca

SEQ ID NO: 4465 - RNA, 19 nt, Artificial Sequence
  Description of Artificial Sequence: Synthetic oligonucleotide
aaaaggccuuggauuuauc

SEQ ID NO: 4466 - RNA, 19 nt, Artificial Sequence
  Description of Artificial Sequence: Synthetic oligonucleotide
gauaaauccaaggccuuuu

SEQ ID NO: 4467 - RNA, 19 nt, Artificial Sequence
  Description of Artificial Sequence: Synthetic oligonucleotide
aaaggccuuggauuuaucc

SEQ ID NO: 4468 - RNA, 19 nt, Artificial Sequence
  Description of Artificial Sequence: Synthetic oligonucleotide
ggauaaauccaaggccuuu

SEQ ID NO: 4469 - RNA, 19 nt, Artificial Sequence
  Description of Artificial Sequence: Synthetic oligonucleotide
aaggccuuggauuuauccc

SEQ ID NO: 4470 - RNA, 19 nt, Artificial Sequence
  Description of Artificial Sequence: Synthetic oligonucleotide
gggauaaauccaaggccuu

SEQ ID NO: 4471 - RNA, 19 nt, Artificial Sequence
  Description of Artificial Sequence: Synthetic oligonucleotide
ccuuggauuuaucccugua

SEQ ID NO: 4472 - RNA, 19 nt, Artificial Sequence
  Description of Artificial Sequence: Synthetic oligonucleotide
uacagggauaaauccaagg

SEQ ID NO: 4473 - RNA, 19 nt, Artificial Sequence
  Description of Artificial Sequence: Synthetic oligonucleotide
cuuggauuuaucccuguac

SEQ ID NO: 4474 - RNA, 19 nt, Artificial Sequence
  Description of Artificial Sequence: Synthetic oligonucleotide
guacagggauaaauccaag

SEQ ID NO: 4475 - RNA, 19 nt, Artificial Sequence
  Description of Artificial Sequence: Synthetic oligonucleotide
uuggauuuaucccuguacu

SEQ ID NO: 4476 - RNA, 19 nt, Artificial Sequence
  Description of Artificial Sequence: Synthetic oligonucleotide
aguacagggauaaauccaa

SEQ ID NO: 4477 - RNA, 19 nt, Artificial Sequence
  Description of Artificial Sequence: Synthetic oligonucleotide
uggauuuaucccuguacuu

SEQ ID NO: 4478 - RNA, 19 nt, Artificial Sequence
  Description of Artificial Sequence: Synthetic oligonucleotide
aaguacagggauaaaucca

SEQ ID NO: 4479 - RNA, 19 nt, Artificial Sequence
  Description of Artificial Sequence: Synthetic oligonucleotide
ggauuuaucccuguacuug

SEQ ID NO: 4480 - RNA, 19 nt, Artificial Sequence
  Description of Artificial Sequence: Synthetic oligonucleotide
caaguacagggauaaaucc

SEQ ID NO: 4481 - RNA, 19 nt, Artificial Sequence
  Description of Artificial Sequence: Synthetic oligonucleotide
auuaugcccguguuucaag

SEQ ID NO: 4482 - RNA, 19 nt, Artificial Sequence
  Description of Artificial Sequence: Synthetic oligonucleotide
cuugaaacacgggcauaau

SEQ ID NO: 4483 - RNA, 19 nt, Artificial Sequence
  Description of Artificial Sequence: Synthetic oligonucleotide
uuaugcccguguuucaagg

SEQ ID NO: 4484 - RNA, 19 nt, Artificial Sequence
  Description of Artificial Sequence: Synthetic oligonucleotide
ccuugaaacacgggcauaa

SEQ ID NO: 4485 - RNA, 19 nt, Artificial Sequence
  Description of Artificial Sequence: Synthetic oligonucleotide
uaugcccguguuucaaggu

SEQ ID NO: 4486 - RNA, 19 nt, Artificial Sequence
  Description of Artificial Sequence: Synthetic oligonucleotide
accuugaaacacgggcaua

SEQ ID NO: 4487 - RNA, 19 nt, Artificial Sequence
  Description of Artificial Sequence: Synthetic oligonucleotide
augcccguguuucaagguu

SEQ ID NO: 4488 - RNA, 19 nt, Artificial Sequence
  Description of Artificial Sequence: Synthetic oligonucleotide
aaccuugaaacacgggcau

SEQ ID NO: 4489 - RNA, 19 nt, Artificial Sequence
  Description of Artificial Sequence: Synthetic oligonucleotide
ugcccguguuucaagguuu

SEQ ID NO: 4490 - RNA, 19 nt, Artificial Sequence
  Description of Artificial Sequence: Synthetic oligonucleotide
aaaccuugaaacacgggca

SEQ ID NO: 4491 - RNA, 19 nt, Artificial Sequence
  Description of Artificial Sequence: Synthetic oligonucleotide
caagguuugaaugagcuga

SEQ ID NO: 4492 - RNA, 19 nt, Artificial Sequence
  Description of Artificial Sequence: Synthetic oligonucleotide
ucagcucauucaaaccuug

SEQ ID NO: 4493 - RNA, 19 nt, Artificial Sequence
  Description of Artificial Sequence: Synthetic oligonucleotide
cugauuccuauguauaagu

SEQ ID NO: 4494 - RNA, 19 nt, Artificial Sequence
  Description of Artificial Sequence: Synthetic oligonucleotide
acuuauacauaggaaucag

SEQ ID NO: 4495 - RNA, 19 nt, Artificial Sequence
  Description of Artificial Sequence: Synthetic oligonucleotide
ccuauguauaaguuaaugg

SEQ ID NO: 4496 - RNA, 19 nt, Artificial Sequence
  Description of Artificial Sequence: Synthetic oligonucleotide
ccauuaacuuauacauagg

SEQ ID NO: 4497 - RNA, 19 nt, Artificial Sequence
  Description of Artificial Sequence: Synthetic oligonucleotide
aacucaauucaaggccuuc

SEQ ID NO: 4498 - RNA, 19 nt, Artificial Sequence
  Description of Artificial Sequence: Synthetic oligonucleotide
gaaggccuugaauugaguu

SEQ ID NO: 4499 - RNA, 19 nt, Artificial Sequence
  Description of Artificial Sequence: Synthetic oligonucleotide
acucaauucaaggccuucc

SEQ ID NO: 4500 - RNA, 19 nt, Artificial Sequence
  Description of Artificial Sequence: Synthetic oligonucleotide
ggaaggccuugaauugagu

SEQ ID NO: 4501 - RNA, 19 nt, Artificial Sequence
  Description of Artificial Sequence: Synthetic oligonucleotide
cucaauucaaggccuuccu

SEQ ID NO: 4502 - RNA, 19 nt, Artificial Sequence
  Description of Artificial Sequence: Synthetic oligonucleotide
aggaaggccuugaauugag

SEQ ID NO: 4503 - RNA, 19 nt, Artificial Sequence
  Description of Artificial Sequence: Synthetic oligonucleotide
ucaauucaaggccuuccuc

SEQ ID NO: 4504 - RNA, 19 nt, Artificial Sequence
  Description of Artificial Sequence: Synthetic oligonucleotide
gaggaaggccuugaauuga

SEQ ID NO: 4505 - RNA, 19 nt, Artificial Sequence
  Description of Artificial Sequence: Synthetic oligonucleotide
uucaaggccuuccucauca

SEQ ID NO: 4506 - RNA, 19 nt, Artificial Sequence
  Description of Artificial Sequence: Synthetic oligonucleotide
ugaugaggaaggccuugaa

SEQ ID NO: 4507 - RNA, 19 nt, Artificial Sequence
  Description of Artificial Sequence: Synthetic oligonucleotide
uccucaucaggcugcuaag

SEQ ID NO: 4508 - RNA, 19 nt, Artificial Sequence
  Description of Artificial Sequence: Synthetic oligonucleotide
cuuagcagccugaugagga

SEQ ID NO: 4509 - RNA, 19 nt, Artificial Sequence
  Description of Artificial Sequence: Synthetic oligonucleotide
ccucaucaggcugcuaagg

SEQ ID NO: 4510 - RNA, 19 nt, Artificial Sequence
  Description of Artificial Sequence: Synthetic oligonucleotide
ccuuagcagccugaugagg

SEQ ID NO: 4511 - RNA, 19 nt, Artificial Sequence
  Description of Artificial Sequence: Synthetic oligonucleotide
ucaggcugcuaagggaccu

SEQ ID NO: 4512 - RNA, 19 nt, Artificial Sequence
  Description of Artificial Sequence: Synthetic oligonucleotide
aggucccuuagcagccuga

SEQ ID NO: 4513 - RNA, 19 nt, Artificial Sequence
  Description of Artificial Sequence: Synthetic oligonucleotide
caggcugcuaagggaccuc

SEQ ID NO: 4514 - RNA, 19 nt, Artificial Sequence
  Description of Artificial Sequence: Synthetic oligonucleotide
gaggucccuuagcagccug

SEQ ID NO: 4515 - RNA, 19 nt, Artificial Sequence
  Description of Artificial Sequence: Synthetic oligonucleotide
aggcugcuaagggaccuca

SEQ ID NO: 4516 - RNA, 19 nt, Artificial Sequence
  Description of Artificial Sequence: Synthetic oligonucleotide
ugaggucccuuagcagccu

SEQ ID NO: 4517 - RNA, 19 nt, Artificial Sequence
  Description of Artificial Sequence: Synthetic oligonucleotide
ggcugcuaagggaccucau

SEQ ID NO: 4518 - RNA, 19 nt, Artificial Sequence
  Description of Artificial Sequence: Synthetic oligonucleotide
augaggucccuuagcagcc

SEQ ID NO: 4519 - RNA, 19 nt, Artificial Sequence
  Description of Artificial Sequence: Synthetic oligonucleotide
gcugcuaagggaccucauu

SEQ ID NO: 4520 - RNA, 19 nt, Artificial Sequence
  Description of Artificial Sequence: Synthetic oligonucleotide
aaugaggucccuuagcagc

SEQ ID NO: 4521 - RNA, 19 nt, Artificial Sequence
  Description of Artificial Sequence: Synthetic oligonucleotide
cugcuaagggaccucauug

SEQ ID NO: 4522 - RNA, 19 nt, Artificial Sequence
  Description of Artificial Sequence: Synthetic oligonucleotide
caaugaggucccuuagcag

SEQ ID NO: 4523 - RNA, 19 nt, Artificial Sequence
  Description of Artificial Sequence: Synthetic oligonucleotide
ugcuaagggaccucauuga

SEQ ID NO: 4524 - RNA, 19 nt, Artificial Sequence
  Description of Artificial Sequence: Synthetic oligonucleotide
ucaaugaggucccuuagca

SEQ ID NO: 4525 - RNA, 19 nt, Artificial Sequence
  Description of Artificial Sequence: Synthetic oligonucleotide
gcuaagggaccucauugau

SEQ ID NO: 4526 - RNA, 19 nt, Artificial Sequence
  Description of Artificial Sequence: Synthetic oligonucleotide
aucaaugaggucccuuagc

SEQ ID NO: 4527 - RNA, 19 nt, Artificial Sequence
  Description of Artificial Sequence: Synthetic oligonucleotide
cuaagggaccucauugaua

SEQ ID NO: 4528 - RNA, 19 nt, Artificial Sequence
  Description of Artificial Sequence: Synthetic oligonucleotide
uaucaaugaggucccuuag

SEQ ID NO: 4529 - RNA, 19 nt, Artificial Sequence
  Description of Artificial Sequence: Synthetic oligonucleotide
aagggaccucauugauaag

SEQ ID NO: 4530 - RNA, 19 nt, Artificial Sequence
  Description of Artificial Sequence: Synthetic oligonucleotide
cuuaucaaugaggucccuu

SEQ ID NO: 4531 - RNA, 19 nt, Artificial Sequence
  Description of Artificial Sequence: Synthetic oligonucleotide
agggaccucauugauaagc

SEQ ID NO: 4532 - RNA, 19 nt, Artificial Sequence
  Description of Artificial Sequence: Synthetic oligonucleotide
gcuuaucaaugaggucccu

SEQ ID NO: 4533 - RNA, 19 nt, Artificial Sequence
  Description of Artificial Sequence: Synthetic oligonucleotide
gggaccucauugauaagca

SEQ ID NO: 4534 - RNA, 19 nt, Artificial Sequence
  Description of Artificial Sequence: Synthetic oligonucleotide
ugcuuaucaaugagguccc

SEQ ID NO: 4535 - RNA, 19 nt, Artificial Sequence
  Description of Artificial Sequence: Synthetic oligonucleotide
ggaccucauugauaagcag

SEQ ID NO: 4536 - RNA, 19 nt, Artificial Sequence
  Description of Artificial Sequence: Synthetic oligonucleotide
cugcuuaucaaugaggucc

SEQ ID NO: 4537 - RNA, 19 nt, Artificial Sequence
  Description of Artificial Sequence: Synthetic oligonucleotide
gaccucauugauaagcaga

SEQ ID NO: 4538 - RNA, 19 nt, Artificial Sequence
  Description of Artificial Sequence: Synthetic oligonucleotide
ucugcuuaucaaugagguc

SEQ ID NO: 4539 - RNA, 19 nt, Artificial Sequence
  Description of Artificial Sequence: Synthetic oligonucleotide
auugauaagcagacaugga

SEQ ID NO: 4540 - RNA, 19 nt, Artificial Sequence
  Description of Artificial Sequence: Synthetic oligonucleotide
uccaugucugcuuaucaau

SEQ ID NO: 4541 - RNA, 19 nt, Artificial Sequence
  Description of Artificial Sequence: Synthetic oligonucleotide
gauaagcagacauggacag

SEQ ID NO: 4542 - RNA, 19 nt, Artificial Sequence
  Description of Artificial Sequence: Synthetic oligonucleotide
cuguccaugucugcuuauc

SEQ ID NO: 4543 - RNA, 19 nt, Artificial Sequence
  Description of Artificial Sequence: Synthetic oligonucleotide
auaagcagacauggacaga

SEQ ID NO: 4544 - RNA, 19 nt, Artificial Sequence
  Description of Artificial Sequence: Synthetic oligonucleotide
ucuguccaugucugcuuau

SEQ ID NO: 4545 - RNA, 19 nt, Artificial Sequence
  Description of Artificial Sequence: Synthetic oligonucleotide
uaagcagacauggacagac

SEQ ID NO: 4546 - RNA, 19 nt, Artificial Sequence
  Description of Artificial Sequence: Synthetic oligonucleotide
gucuguccaugucugcuua

SEQ ID NO: 4547 - RNA, 19 nt, Artificial Sequence
  Description of Artificial Sequence: Synthetic oligonucleotide
agcagacauggacagacga

SEQ ID NO: 4548 - RNA, 19 nt, Artificial Sequence
  Description of Artificial Sequence: Synthetic oligonucleotide
ucgucuguccaugucugcu

SEQ ID NO: 4549 - RNA, 19 nt, Artificial Sequence
  Description of Artificial Sequence: Synthetic oligonucleotide
gcagacauggacagacgag

SEQ ID NO: 4550 - RNA, 19 nt, Artificial Sequence
  Description of Artificial Sequence: Synthetic oligonucleotide
cucgucuguccaugucugc

SEQ ID NO: 4551 - RNA, 19 nt, Artificial Sequence
  Description of Artificial Sequence: Synthetic oligonucleotide
cagacauggacagacgagg

SEQ ID NO: 4552 - RNA, 19 nt, Artificial Sequence
  Description of Artificial Sequence: Synthetic oligonucleotide
ccucgucuguccaugucug

SEQ ID NO: 4553 - RNA, 19 nt, Artificial Sequence
  Description of Artificial Sequence: Synthetic oligonucleotide
agacauggacagacgaggg

SEQ ID NO: 4554 - RNA, 19 nt, Artificial Sequence
  Description of Artificial Sequence: Synthetic oligonucleotide
cccucgucuguccaugucu

SEQ ID NO: 4555 - RNA, 19 nt, Artificial Sequence
  Description of Artificial Sequence: Synthetic oligonucleotide
gacauggacagacgagggc

SEQ ID NO: 4556 - RNA, 19 nt, Artificial Sequence
  Description of Artificial Sequence: Synthetic oligonucleotide
gcccucgucuguccauguc

SEQ ID NO: 4557 - RNA, 19 nt, Artificial Sequence
  Description of Artificial Sequence: Synthetic oligonucleotide
uggacagacgagggcucag

SEQ ID NO: 4558 - RNA, 19 nt, Artificial Sequence
  Description of Artificial Sequence: Synthetic oligonucleotide
cugagcccucgucugucca

SEQ ID NO: 4559 - RNA, 19 nt, Artificial Sequence
  Description of Artificial Sequence: Synthetic oligonucleotide
gacagacgagggcucaguc

SEQ ID NO: 4560 - RNA, 19 nt, Artificial Sequence
  Description of Artificial Sequence: Synthetic oligonucleotide
gacugagcccucgucuguc

SEQ ID NO: 4561 - RNA, 19 nt, Artificial Sequence
  Description of Artificial Sequence: Synthetic oligonucleotide
gacgagggcucagucucag

SEQ ID NO: 4562 - RNA, 19 nt, Artificial Sequence
  Description of Artificial Sequence: Synthetic oligonucleotide
cugagacugagcccucguc

SEQ ID NO: 4563 - RNA, 19 nt, Artificial Sequence
  Description of Artificial Sequence: Synthetic oligonucleotide
acgagggcucagucucaga

SEQ ID NO: 4564 - RNA, 19 nt, Artificial Sequence
  Description of Artificial Sequence: Synthetic oligonucleotide
ucugagacugagcccucgu

SEQ ID NO: 4565 - RNA, 19 nt, Artificial Sequence
  Description of Artificial Sequence: Synthetic oligonucleotide
aacuacuacuccucgccug

SEQ ID NO: 4566 - RNA, 19 nt, Artificial Sequence
  Description of Artificial Sequence: Synthetic oligonucleotide
caggcgaggaguaguaguu

SEQ ID NO: 4567 - RNA, 19 nt, Artificial Sequence
  Description of Artificial Sequence: Synthetic oligonucleotide
acuacuacuccucgccugu

SEQ ID NO: 4568 - RNA, 19 nt, Artificial Sequence
  Description of Artificial Sequence: Synthetic oligonucleotide
acaggcgaggaguaguagu

SEQ ID NO: 4569 - RNA, 19 nt, Artificial Sequence
  Description of Artificial Sequence: Synthetic oligonucleotide
cuacuacuccucgccugug

SEQ ID NO: 4570 - RNA, 19 nt, Artificial Sequence
  Description of Artificial Sequence: Synthetic oligonucleotide
cacaggcgaggaguaguag

SEQ ID NO: 4571 - RNA, 19 nt, Artificial Sequence
  Description of Artificial Sequence: Synthetic oligonucleotide
uacuacuccucgccugugu

SEQ ID NO: 4572 - RNA, 19 nt, Artificial Sequence
  Description of Artificial Sequence: Synthetic oligonucleotide
acacaggcgaggaguagua

SEQ ID NO: 4573 - RNA, 19 nt, Artificial Sequence
  Description of Artificial Sequence: Synthetic oligonucleotide
acuacuccucgccugugug

SEQ ID NO: 4574 - RNA, 19 nt, Artificial Sequence
  Description of Artificial Sequence: Synthetic oligonucleotide
cacacaggcgaggaguagu

SEQ ID NO: 4575 - RNA, 19 nt, Artificial Sequence
  Description of Artificial Sequence: Synthetic oligonucleotide
cuacuccucgccugugugc

SEQ ID NO: 4576 - RNA, 19 nt, Artificial Sequence
  Description of Artificial Sequence: Synthetic oligonucleotide
gcacacaggcgaggaguag

SEQ ID NO: 4577 - RNA, 19 nt, Artificial Sequence
  Description of Artificial Sequence: Synthetic oligonucleotide
uacuccucgccugugugca

SEQ ID NO: 4578 - RNA, 19 nt, Artificial Sequence
  Description of Artificial Sequence: Synthetic oligonucleotide
ugcacacaggcgaggagua

SEQ ID NO: 4579 - RNA, 19 nt, Artificial Sequence
  Description of Artificial Sequence: Synthetic oligonucleotide
acuccucgccugugugcac

SEQ ID NO: 4580 - RNA, 19 nt, Artificial Sequence
  Description of Artificial Sequence: Synthetic oligonucleotide
gugcacacaggcgaggagu

SEQ ID NO: 4581 - RNA, 19 nt, Artificial Sequence
  Description of Artificial Sequence: Synthetic oligonucleotide
uacagagggcagaaggcua

SEQ ID NO: 4582 - RNA, 19 nt, Artificial Sequence
  Description of Artificial Sequence: Synthetic oligonucleotide
uagccuucugcccucugua

SEQ ID NO: 4583 - RNA, 19 nt, Artificial Sequence
  Description of Artificial Sequence: Synthetic oligonucleotide
acagagggcagaaggcuau

SEQ ID NO: 4584 - RNA, 19 nt, Artificial Sequence
  Description of Artificial Sequence: Synthetic oligonucleotide
auagccuucugcccucugu

SEQ ID NO: 4585 - RNA, 19 nt, Artificial Sequence
  Description of Artificial Sequence: Synthetic oligonucleotide
agagggcagaaggcuauuu

SEQ ID NO: 4586 - RNA, 19 nt, Artificial Sequence
  Description of Artificial Sequence: Synthetic oligonucleotide
aaauagccuucugcccucu

SEQ ID NO: 4587 - RNA, 19 nt, Artificial Sequence
  Description of Artificial Sequence: Synthetic oligonucleotide
gagggcagaaggcuauuuc

SEQ ID NO: 4588 - RNA, 19 nt, Artificial Sequence
  Description of Artificial Sequence: Synthetic oligonucleotide
gaaauagccuucugcccuc

SEQ ID NO: 4589 - RNA, 19 nt, Artificial Sequence
  Description of Artificial Sequence: Synthetic oligonucleotide
gcagaaggcuauuucagaa

SEQ ID NO: 4590 - RNA, 19 nt, Artificial Sequence
  Description of Artificial Sequence: Synthetic oligonucleotide
uucugaaauagccuucugc

SEQ ID NO: 4591 - RNA, 19 nt, Artificial Sequence
  Description of Artificial Sequence: Synthetic oligonucleotide
ccugucgacgugaccuugg

SEQ ID NO: 4592 - RNA, 19 nt, Artificial Sequence
  Description of Artificial Sequence: Synthetic oligonucleotide
ccaaggucacgucgacagg

SEQ ID NO: 4593 - RNA, 19 nt, Artificial Sequence
  Description of Artificial Sequence: Synthetic oligonucleotide
cugucgacgugaccuuggc

SEQ ID NO: 4594 - RNA, 19 nt, Artificial Sequence
  Description of Artificial Sequence: Synthetic oligonucleotide
gccaaggucacgucgacag

SEQ ID NO: 4595 - RNA, 19 nt, Artificial Sequence
  Description of Artificial Sequence: Synthetic oligonucleotide
ugucgacgugaccuuggca

SEQ ID NO: 4596 - RNA, 19 nt, Artificial Sequence
  Description of Artificial Sequence: Synthetic oligonucleotide
ugccaaggucacgucgaca

SEQ ID NO: 4597 - RNA, 19 nt, Artificial Sequence
  Description of Artificial Sequence: Synthetic oligonucleotide
gucgacgugaccuuggcag

SEQ ID NO: 4598 - RNA, 19 nt, Artificial Sequence
  Description of Artificial Sequence: Synthetic oligonucleotide
cugccaaggucacgucgac

SEQ ID NO: 4599 - RNA, 19 nt, Artificial Sequence
  Description of Artificial Sequence: Synthetic oligonucleotide
ucgacgugaccuuggcagu

SEQ ID NO: 4600 - RNA, 19 nt, Artificial Sequence
  Description of Artificial Sequence: Synthetic oligonucleotide
acugccaaggucacgucga

SEQ ID NO: 4601 - RNA, 19 nt, Artificial Sequence
  Description of Artificial Sequence: Synthetic oligonucleotide
ugaccuuggcaguguuugc

SEQ ID NO: 4602 - RNA, 19 nt, Artificial Sequence
  Description of Artificial Sequence: Synthetic oligonucleotide
gcaaacacugccaagguca

SEQ ID NO: 4603 - RNA, 19 nt, Artificial Sequence
  Description of Artificial Sequence: Synthetic oligonucleotide
ccuuggcaguguuugcugu

SEQ ID NO: 4604 - RNA, 19 nt, Artificial Sequence
  Description of Artificial Sequence: Synthetic oligonucleotide
acagcaaacacugccaagg

SEQ ID NO: 4605 - RNA, 19 nt, Artificial Sequence
  Description of Artificial Sequence: Synthetic oligonucleotide
uuggcaguguuugcugugg

SEQ ID NO: 4606 - RNA, 19 nt, Artificial Sequence
  Description of Artificial Sequence: Synthetic oligonucleotide
ccacagcaaacacugccaa

SEQ ID NO: 4607 - RNA, 19 nt, Artificial Sequence
  Description of Artificial Sequence: Synthetic oligonucleotide
uggcaguguuugcuguggg

SEQ ID NO: 4608 - RNA, 19 nt, Artificial Sequence
  Description of Artificial Sequence: Synthetic oligonucleotide
cccacagcaaacacugcca

SEQ ID NO: 4609 - RNA, 19 nt, Artificial Sequence
  Description of Artificial Sequence: Synthetic oligonucleotide
cagagcacagaaggcuggg

SEQ ID NO: 4610 - RNA, 19 nt, Artificial Sequence
  Description of Artificial Sequence: Synthetic oligonucleotide
cccagccuucugugcucug

SEQ ID NO: 4611 - RNA, 19 nt, Artificial Sequence
  Description of Artificial Sequence: Synthetic oligonucleotide
agagcacagaaggcuggga

SEQ ID NO: 4612 - RNA, 19 nt, Artificial Sequence
  Description of Artificial Sequence: Synthetic oligonucleotide
ucccagccuucugugcucu

SEQ ID NO: 4613 - RNA, 19 nt, Artificial Sequence
  Description of Artificial Sequence: Synthetic oligonucleotide
gagcacagaaggcugggau

SEQ ID NO: 4614 - RNA, 19 nt, Artificial Sequence
  Description of Artificial Sequence: Synthetic oligonucleotide
aucccagccuucugugcuc

SEQ ID NO: 4615 - RNA, 19 nt, Artificial Sequence
  Description of Artificial Sequence: Synthetic oligonucleotide
agcacagaaggcugggauu

SEQ ID NO: 4616 - RNA, 19 nt, Artificial Sequence
  Description of Artificial Sequence: Synthetic oligonucleotide
aaucccagccuucugugcu

SEQ ID NO: 4617 - RNA, 19 nt, Artificial Sequence
  Description of Artificial Sequence: Synthetic oligonucleotide
gcacagaaggcugggauuu

SEQ ID NO: 4618 - RNA, 19 nt, Artificial Sequence
  Description of Artificial Sequence: Synthetic oligonucleotide
aaaucccagccuucugugc

SEQ ID NO: 4619 - RNA, 19 nt, Artificial Sequence
  Description of Artificial Sequence: Synthetic oligonucleotide
acagaaggcugggauuuuc

SEQ ID NO: 4620 - RNA, 19 nt, Artificial Sequence
  Description of Artificial Sequence: Synthetic oligonucleotide
gaaaaucccagccuucugu

SEQ ID NO: 4621 - RNA, 19 nt, Artificial Sequence
  Description of Artificial Sequence: Synthetic oligonucleotide
aguuuucuuuguccaguac

SEQ ID NO: 4622 - RNA, 19 nt, Artificial Sequence
  Description of Artificial Sequence: Synthetic oligonucleotide
guacuggacaaagaaaacu

SEQ ID NO: 4623 - RNA, 19 nt, Artificial Sequence
  Description of Artificial Sequence: Synthetic oligonucleotide
guuuucuuuguccaguacu

SEQ ID NO: 4624 - RNA, 19 nt, Artificial Sequence
  Description of Artificial Sequence: Synthetic oligonucleotide
aguacuggacaaagaaaac

SEQ ID NO: 4625 - RNA, 19 nt, Artificial Sequence
  Description of Artificial Sequence: Synthetic oligonucleotide
uuuucuuuguccaguacug

SEQ ID NO: 4626 - RNA, 19 nt, Artificial Sequence
  Description of Artificial Sequence: Synthetic oligonucleotide
caguacuggacaaagaaaa

SEQ ID NO: 4627 - RNA, 19 nt, Artificial Sequence
  Description of Artificial Sequence: Synthetic oligonucleotide
uuucuuuguccaguacuga

SEQ ID NO: 4628 - RNA, 19 nt, Artificial Sequence
  Description of Artificial Sequence: Synthetic oligonucleotide
ucaguacuggacaaagaaa

SEQ ID NO: 4629 - RNA, 19 nt, Artificial Sequence
  Description of Artificial Sequence: Synthetic oligonucleotide
uucuuuguccaguacugag

SEQ ID NO: 4630 - RNA, 19 nt, Artificial Sequence
  Description of Artificial Sequence: Synthetic oligonucleotide
cucaguacuggacaaagaa

SEQ ID NO: 4631 - RNA, 19 nt, Artificial Sequence
  Description of Artificial Sequence: Synthetic oligonucleotide
aaaagcuucaauggcuacu

SEQ ID NO: 4632 - RNA, 19 nt, Artificial Sequence
  Description of Artificial Sequence: Synthetic oligonucleotide
aguagccauugaagcuuuu

SEQ ID NO: 4633 - RNA, 19 nt, Artificial Sequence
  Description of Artificial Sequence: Synthetic oligonucleotide
aaagcuucaauggcuacua

SEQ ID NO: 4634 - RNA, 19 nt, Artificial Sequence
  Description of Artificial Sequence: Synthetic oligonucleotide
uaguagccauugaagcuuu

SEQ ID NO: 4635 - RNA, 19 nt, Artificial Sequence
  Description of Artificial Sequence: Synthetic oligonucleotide
cuucaauggcuacuagaug

SEQ ID NO: 4636 - RNA, 19 nt, Artificial Sequence
  Description of Artificial Sequence: Synthetic oligonucleotide
caucuaguagccauugaag

SEQ ID NO: 4637 - RNA, 19 nt, Artificial Sequence
  Description of Artificial Sequence: Synthetic oligonucleotide
uucaauggcuacuagauga

SEQ ID NO: 4638 - RNA, 19 nt, Artificial Sequence
  Description of Artificial Sequence: Synthetic oligonucleotide
ucaucuaguagccauugaa

SEQ ID NO: 4639 - RNA, 19 nt, Artificial Sequence
  Description of Artificial Sequence: Synthetic oligonucleotide
ucaauggcuacuagaugaa

SEQ ID NO: 4640 - RNA, 19 nt, Artificial Sequence
  Description of Artificial Sequence: Synthetic oligonucleotide
uucaucuaguagccauuga

SEQ ID NO: 4641 - RNA, 19 nt, Artificial Sequence
  Description of Artificial Sequence: Synthetic oligonucleotide
caaauucuuacacucauug

SEQ ID NO: 4642 - RNA, 19 nt, Artificial Sequence
  Description of Artificial Sequence: Synthetic oligonucleotide
caaugaguguaagaauuug

SEQ ID NO: 4643 - RNA, 19 nt, Artificial Sequence
  Description of Artificial Sequence: Synthetic oligonucleotide
aaauucuuacacucauugg

SEQ ID NO: 4644 - RNA, 19 nt, Artificial Sequence
  Description of Artificial Sequence: Synthetic oligonucleotide
ccaaugaguguaagaauuu

SEQ ID NO: 4645 - RNA, 19 nt, Artificial Sequence
  Description of Artificial Sequence: Synthetic oligonucleotide
aauucuuacacucauuggc

SEQ ID NO: 4646 - RNA, 19 nt, Artificial Sequence
  Description of Artificial Sequence: Synthetic oligonucleotide
gccaaugaguguaagaauu

SEQ ID NO: 4647 - RNA, 19 nt, Artificial Sequence
  Description of Artificial Sequence: Synthetic oligonucleotide
auucuuacacucauuggca

SEQ ID NO: 4648 - RNA, 19 nt, Artificial Sequence
  Description of Artificial Sequence: Synthetic oligonucleotide
ugccaaugaguguaagaau

SEQ ID NO: 4649 - RNA, 19 nt, Artificial Sequence
  Description of Artificial Sequence: Synthetic oligonucleotide
uucuuacacucauuggcag

SEQ ID NO: 4650 - RNA, 19 nt, Artificial Sequence
  Description of Artificial Sequence: Synthetic oligonucleotide
cugccaaugaguguaagaa

SEQ ID NO: 4651 - RNA, 19 nt, Artificial Sequence
  Description of Artificial Sequence: Synthetic oligonucleotide
ucuuacacucauuggcagg

SEQ ID NO: 4652 - RNA, 19 nt, Artificial Sequence
  Description of Artificial Sequence: Synthetic oligonucleotide
ccugccaaugaguguaaga

SEQ ID NO: 4653 - RNA, 19 nt, Artificial Sequence
  Description of Artificial Sequence: Synthetic oligonucleotide
cuuacacucauuggcagga

SEQ ID NO: 4654 - RNA, 19 nt, Artificial Sequence
  Description of Artificial Sequence: Synthetic oligonucleotide
uccugccaaugaguguaag

SEQ ID NO: 4655 - RNA, 19 nt, Artificial Sequence
  Description of Artificial Sequence: Synthetic oligonucleotide
uuacacucauuggcaggaa

SEQ ID NO: 4656 - RNA, 19 nt, Artificial Sequence
  Description of Artificial Sequence: Synthetic oligonucleotide
uuccugccaaugaguguaa

SEQ ID NO: 4657 - RNA, 19 nt, Artificial Sequence
  Description of Artificial Sequence: Synthetic oligonucleotide
uggccuggcaauuucugag

SEQ ID NO: 4658 - RNA, 19 nt, Artificial Sequence
  Description of Artificial Sequence: Synthetic oligonucleotide
cucagaaauugccaggcca

SEQ ID NO: 4659 - RNA, 19 nt, Artificial Sequence
  Description of Artificial Sequence: Synthetic oligonucleotide
ggccuggcaauuucugagg

SEQ ID NO: 4660 - RNA, 19 nt, Artificial Sequence
  Description of Artificial Sequence: Synthetic oligonucleotide
ccucagaaauugccaggcc

SEQ ID NO: 4661 - RNA, 19 nt, Artificial Sequence
  Description of Artificial Sequence: Synthetic oligonucleotide
gccuggcaauuucugagga

SEQ ID NO: 4662 - RNA, 19 nt, Artificial Sequence
  Description of Artificial Sequence: Synthetic oligonucleotide
uccucagaaauugccaggc

SEQ ID NO: 4663 - RNA, 19 nt, Artificial Sequence
  Description of Artificial Sequence: Synthetic oligonucleotide
acuuggcucaucuuccaua

SEQ ID NO: 4664 - RNA, 19 nt, Artificial Sequence
  Description of Artificial Sequence: Synthetic oligonucleotide
uauggaagaugagccaagu

SEQ ID NO: 4665 - RNA, 19 nt, Artificial Sequence
  Description of Artificial Sequence: Synthetic oligonucleotide
cuuggcucaucuuccauag

SEQ ID NO: 4666 - RNA, 19 nt, Artificial Sequence
  Description of Artificial Sequence: Synthetic oligonucleotide
cuauggaagaugagccaag

SEQ ID NO: 4667 - RNA, 19 nt, Artificial Sequence
  Description of Artificial Sequence: Synthetic oligonucleotide
gcucaucuuccauagccca

SEQ ID NO: 4668 - RNA, 19 nt, Artificial Sequence
  Description of Artificial Sequence: Synthetic oligonucleotide
ugggcuauggaagaugagc

SEQ ID NO: 4669 - RNA, 19 nt, Artificial Sequence
  Description of Artificial Sequence: Synthetic oligonucleotide
cucaucuuccauagcccac

SEQ ID NO: 4670 - RNA, 19 nt, Artificial Sequence
  Description of Artificial Sequence: Synthetic oligonucleotide
gugggcuauggaagaugag

SEQ ID NO: 4671 - RNA, 19 nt, Artificial Sequence
  Description of Artificial Sequence: Synthetic oligonucleotide
cauagcccacaugguaaug

SEQ ID NO: 4672 - RNA, 19 nt, Artificial Sequence
  Description of Artificial Sequence: Synthetic oligonucleotide
cauuaccaugugggcuaug

SEQ ID NO: 4673 - RNA, 19 nt, Artificial Sequence
  Description of Artificial Sequence: Synthetic oligonucleotide
auagcccacaugguaaugg

SEQ ID NO: 4674 - RNA, 19 nt, Artificial Sequence
  Description of Artificial Sequence: Synthetic oligonucleotide
ccauuaccaugugggcuau

SEQ ID NO: 4675 - RNA, 19 nt, Artificial Sequence
  Description of Artificial Sequence: Synthetic oligonucleotide
ccacaugguaauggguaca

SEQ ID NO: 4676 - RNA, 19 nt, Artificial Sequence
  Description of Artificial Sequence: Synthetic oligonucleotide
uguacccauuaccaugugg

SEQ ID NO: 4677 - RNA, 19 nt, Artificial Sequence
  Description of Artificial Sequence: Synthetic oligonucleotide
acacggcuugaagagguaa

SEQ ID NO: 4678 - RNA, 19 nt, Artificial Sequence
  Description of Artificial Sequence: Synthetic oligonucleotide
uuaccucuucaagccgugu

SEQ ID NO: 4679 - RNA, 19 nt, Artificial Sequence
  Description of Artificial Sequence: Synthetic oligonucleotide
cacggcuugaagagguaaa

SEQ ID NO: 4680 - RNA, 19 nt, Artificial Sequence
  Description of Artificial Sequence: Synthetic oligonucleotide
uuuaccucuucaagccgug

SEQ ID NO: 4681 - RNA, 19 nt, Artificial Sequence
  Description of Artificial Sequence: Synthetic oligonucleotide
acggcuugaagagguaaaa

SEQ ID NO: 4682 - RNA, 19 nt, Artificial Sequence
  Description of Artificial Sequence: Synthetic oligonucleotide
uuuuaccucuucaagccgu

SEQ ID NO: 4683 - RNA, 19 nt, Artificial Sequence
  Description of Artificial Sequence: Synthetic oligonucleotide
cggcuugaagagguaaaag

SEQ ID NO: 4684 - RNA, 19 nt, Artificial Sequence
  Description of Artificial Sequence: Synthetic oligonucleotide
cuuuuaccucuucaagccg

SEQ ID NO: 4685 - RNA, 19 nt, Artificial Sequence
  Description of Artificial Sequence: Synthetic oligonucleotide
ggcuugaagagguaaaagg

SEQ ID NO: 4686 - RNA, 19 nt, Artificial Sequence
  Description of Artificial Sequence: Synthetic oligonucleotide
ccuuuuaccucuucaagcc

SEQ ID NO: 4687 - RNA, 19 nt, Artificial Sequence
  Description of Artificial Sequence: Synthetic oligonucleotide
gcuugaagagguaaaagga

SEQ ID NO: 4688 - RNA, 19 nt, Artificial Sequence
  Description of Artificial Sequence: Synthetic oligonucleotide
uccuuuuaccucuucaagc

SEQ ID NO: 4689 - RNA, 19 nt, Artificial Sequence
  Description of Artificial Sequence: Synthetic oligonucleotide
gaagagguaaaaggauucu

SEQ ID NO: 4690 - RNA, 19 nt, Artificial Sequence
  Description of Artificial Sequence: Synthetic oligonucleotide
agaauccuuuuaccucuuc

SEQ ID NO: 4691 - RNA, 19 nt, Artificial Sequence
  Description of Artificial Sequence: Synthetic oligonucleotide
agagguaaaaggauucuuc

SEQ ID NO: 4692 - RNA, 19 nt, Artificial Sequence
  Description of Artificial Sequence: Synthetic oligonucleotide
gaagaauccuuuuaccucu

SEQ ID NO: 4693 - RNA, 19 nt, Artificial Sequence
  Description of Artificial Sequence: Synthetic oligonucleotide
guaaaaggauucuucagcu

SEQ ID NO: 4694 - RNA, 19 nt, Artificial Sequence
  Description of Artificial Sequence: Synthetic oligonucleotide
agcugaagaauccuuuuac

SEQ ID NO: 4695 - RNA, 19 nt, Artificial Sequence
  Description of Artificial Sequence: Synthetic oligonucleotide
uaaaaggauucuucagcuc

SEQ ID NO: 4696 - RNA, 19 nt, Artificial Sequence
  Description of Artificial Sequence: Synthetic oligonucleotide
gagcugaagaauccuuuua

SEQ ID NO: 4697 - RNA, 19 nt, Artificial Sequence
  Description of Artificial Sequence: Synthetic oligonucleotide
aaaaggauucuucagcucu

SEQ ID NO: 4698 - RNA, 19 nt, Artificial Sequence
  Description of Artificial Sequence: Synthetic oligonucleotide
agagcugaagaauccuuuu

SEQ ID NO: 4699 - RNA, 19 nt, Artificial Sequence
  Description of Artificial Sequence: Synthetic oligonucleotide
aaaggauucuucagcucuu

SEQ ID NO: 4700 - RNA, 19 nt, Artificial Sequence
  Description of Artificial Sequence: Synthetic oligonucleotide
aagagcugaagaauccuuu

SEQ ID NO: 4701 - RNA, 19 nt, Artificial Sequence
  Description of Artificial Sequence: Synthetic oligonucleotide
aaggauucuucagcucuuu

SEQ ID NO: 4702 - RNA, 19 nt, Artificial Sequence
  Description of Artificial Sequence: Synthetic oligonucleotide
aaagagcugaagaauccuu

SEQ ID NO: 4703 - RNA, 19 nt, Artificial Sequence
  Description of Artificial Sequence: Synthetic oligonucleotide
aggauucuucagcucuuug

SEQ ID NO: 4704 - RNA, 19 nt, Artificial Sequence
  Description of Artificial Sequence: Synthetic oligonucleotide
caaagagcugaagaauccu

SEQ ID NO: 4705 - RNA, 19 nt, Artificial Sequence
  Description of Artificial Sequence: Synthetic oligonucleotide
ggauucuucagcucuuuga

SEQ ID NO: 4706 - RNA, 19 nt, Artificial Sequence
  Description of Artificial Sequence: Synthetic oligonucleotide
ucaaagagcugaagaaucc

SEQ ID NO: 4707 - RNA, 19 nt, Artificial Sequence
  Description of Artificial Sequence: Synthetic oligonucleotide
aaaaugguucucagcuccg

SEQ ID NO: 4708 - RNA, 19 nt, Artificial Sequence
  Description of Artificial Sequence: Synthetic oligonucleotide
cggagcugagaaccauuuu

SEQ ID NO: 4709 - RNA, 19 nt, Artificial Sequence
  Description of Artificial Sequence: Synthetic oligonucleotide
aaaugguucucagcuccgu

SEQ ID NO: 4710 - RNA, 19 nt, Artificial Sequence
  Description of Artificial Sequence: Synthetic oligonucleotide
acggagcugagaaccauuu

SEQ ID NO: 4711 - RNA, 19 nt, Artificial Sequence
  Description of Artificial Sequence: Synthetic oligonucleotide
gguucucagcuccguugug

SEQ ID NO: 4712 - RNA, 19 nt, Artificial Sequence
  Description of Artificial Sequence: Synthetic oligonucleotide
cacaacggagcugagaacc

SEQ ID NO: 4713 - RNA, 19 nt, Artificial Sequence
  Description of Artificial Sequence: Synthetic oligonucleotide
guucucagcuccguugugu

SEQ ID NO: 4714 - RNA, 19 nt, Artificial Sequence
  Description of Artificial Sequence: Synthetic oligonucleotide
acacaacggagcugagaac

SEQ ID NO: 4715 - RNA, 19 nt, Artificial Sequence
  Description of Artificial Sequence: Synthetic oligonucleotide
uucucagcuccguuguguc

SEQ ID NO: 4716 - RNA, 19 nt, Artificial Sequence
  Description of Artificial Sequence: Synthetic oligonucleotide
gacacaacggagcugagaa

SEQ ID NO: 4717 - RNA, 19 nt, Artificial Sequence
  Description of Artificial Sequence: Synthetic oligonucleotide
ucucagcuccguugugucc

SEQ ID NO: 4718 - RNA, 19 nt, Artificial Sequence
  Description of Artificial Sequence: Synthetic oligonucleotide
ggacacaacggagcugaga

SEQ ID NO: 4719 - RNA, 19 nt, Artificial Sequence
  Description of Artificial Sequence: Synthetic oligonucleotide
cucagcuccguugugucca

SEQ ID NO: 4720 - RNA, 19 nt, Artificial Sequence
  Description of Artificial Sequence: Synthetic oligonucleotide
uggacacaacggagcugag

SEQ ID NO: 4721 - RNA, 19 nt, Artificial Sequence
  Description of Artificial Sequence: Synthetic oligonucleotide
ucagcuccguuguguccaa

SEQ ID NO: 4722 - RNA, 19 nt, Artificial Sequence
  Description of Artificial Sequence: Synthetic oligonucleotide
uuggacacaacggagcuga

SEQ ID NO: 4723 - RNA, 19 nt, Artificial Sequence
  Description of Artificial Sequence: Synthetic oligonucleotide
aucgguuggauggauaaga

SEQ ID NO: 4724 - RNA, 19 nt, Artificial Sequence
  Description of Artificial Sequence: Synthetic oligonucleotide
ucuuauccauccaaccgau

SEQ ID NO: 4725 - RNA, 19 nt, Artificial Sequence
  Description of Artificial Sequence: Synthetic oligonucleotide
ucgguuggauggauaagaa

SEQ ID NO: 4726 - RNA, 19 nt, Artificial Sequence
  Description of Artificial Sequence: Synthetic oligonucleotide
uucuuauccauccaaccga

SEQ ID NO: 4727 - RNA, 19 nt, Artificial Sequence
  Description of Artificial Sequence: Synthetic oligonucleotide
cgguuggauggauaagaau

SEQ ID NO: 4728 - RNA, 19 nt, Artificial Sequence
  Description of Artificial Sequence: Synthetic oligonucleotide
auucuuauccauccaaccg

SEQ ID NO: 4729 - RNA, 19 nt, Artificial Sequence
  Description of Artificial Sequence: Synthetic oligonucleotide
gguuggauggauaagaauu

SEQ ID NO: 4730 - RNA, 19 nt, Artificial Sequence
  Description of Artificial Sequence: Synthetic oligonucleotide
aauucuuauccauccaacc

SEQ ID NO: 4731 - RNA, 19 nt, Artificial Sequence
  Description of Artificial Sequence: Synthetic oligonucleotide
ggauggauaagaauuuuga

SEQ ID NO: 4732 - RNA, 19 nt, Artificial Sequence
  Description of Artificial Sequence: Synthetic oligonucleotide
ucaaaauucuuauccaucc

SEQ ID NO: 4733 - RNA, 19 nt, Artificial Sequence
  Description of Artificial Sequence: Synthetic oligonucleotide
gauaaaaucagaguguggc

SEQ ID NO: 4734 - RNA, 19 nt, Artificial Sequence
  Description of Artificial Sequence: Synthetic oligonucleotide
gccacacucugauuuuauc

SEQ ID NO: 4735 - RNA, 19 nt, Artificial Sequence
  Description of Artificial Sequence: Synthetic oligonucleotide
uaaaaucagaguguggcug

SEQ ID NO: 4736 - RNA, 19 nt, Artificial Sequence
  Description of Artificial Sequence: Synthetic oligonucleotide
cagccacacucugauuuua

SEQ ID NO: 4737 - RNA, 19 nt, Artificial Sequence
  Description of Artificial Sequence: Synthetic oligonucleotide
aaaaucagaguguggcugc

SEQ ID NO: 4738 - RNA, 19 nt, Artificial Sequence
  Description of Artificial Sequence: Synthetic oligonucleotide
gcagccacacucugauuuu

SEQ ID NO: 4739 - RNA, 19 nt, Artificial Sequence
  Description of Artificial Sequence: Synthetic oligonucleotide
aaaucagaguguggcugca

SEQ ID NO: 4740 - RNA, 19 nt, Artificial Sequence
  Description of Artificial Sequence: Synthetic oligonucleotide
ugcagccacacucugauuu

SEQ ID NO: 4741 - RNA, 19 nt, Artificial Sequence
  Description of Artificial Sequence: Synthetic oligonucleotide
aaucagaguguggcugcaa

SEQ ID NO: 4742 - RNA, 19 nt, Artificial Sequence
  Description of Artificial Sequence: Synthetic oligonucleotide
uugcagccacacucugauu

SEQ ID NO: 4743 - RNA, 19 nt, Artificial Sequence
  Description of Artificial Sequence: Synthetic oligonucleotide
ucagaguguggcugcaaag

SEQ ID NO: 4744 - RNA, 19 nt, Artificial Sequence
  Description of Artificial Sequence: Synthetic oligonucleotide
cuuugcagccacacucuga

SEQ ID NO: 4745 - RNA, 19 nt, Artificial Sequence
  Description of Artificial Sequence: Synthetic oligonucleotide
cagaguguggcugcaaagu

SEQ ID NO: 4746 - RNA, 19 nt, Artificial Sequence
  Description of Artificial Sequence: Synthetic oligonucleotide
acuuugcagccacacucug

SEQ ID NO: 4747 - RNA, 19 nt, Artificial Sequence
  Description of Artificial Sequence: Synthetic oligonucleotide
agaguguggcugcaaagug

SEQ ID NO: 4748 - RNA, 19 nt, Artificial Sequence
  Description of Artificial Sequence: Synthetic oligonucleotide
cacuuugcagccacacucu

SEQ ID NO: 4749 - RNA, 19 nt, Artificial Sequence
  Description of Artificial Sequence: Synthetic oligonucleotide
gaguguggcugcaaaguga

SEQ ID NO: 4750 - RNA, 19 nt, Artificial Sequence
  Description of Artificial Sequence: Synthetic oligonucleotide
ucacuuugcagccacacuc

SEQ ID NO: 4751 - RNA, 19 nt, Artificial Sequence
  Description of Artificial Sequence: Synthetic oligonucleotide
aguguggcugcaaagugaa

SEQ ID NO: 4752 - RNA, 19 nt, Artificial Sequence
  Description of Artificial Sequence: Synthetic oligonucleotide
uucacuuugcagccacacu

SEQ ID NO: 4753 - RNA, 19 nt, Artificial Sequence
  Description of Artificial Sequence: Synthetic oligonucleotide
acaugauccugaagcugac

SEQ ID NO: 4754 - RNA, 19 nt, Artificial Sequence
  Description of Artificial Sequence: Synthetic oligonucleotide
gucagcuucaggaucaugu

SEQ ID NO: 4755 - RNA, 19 nt, Artificial Sequence
  Description of Artificial Sequence: Synthetic oligonucleotide
caugauccugaagcugacg

SEQ ID NO: 4756 - RNA, 19 nt, Artificial Sequence
  Description of Artificial Sequence: Synthetic oligonucleotide
cgucagcuucaggaucaug

SEQ ID NO: 4757 - RNA, 19 nt, Artificial Sequence
  Description of Artificial Sequence: Synthetic oligonucleotide
augauccugaagcugacgc

SEQ ID NO: 4758 - RNA, 19 nt, Artificial Sequence
  Description of Artificial Sequence: Synthetic oligonucleotide
gcgucagcuucaggaucau

SEQ ID NO: 4759 - RNA, 19 nt, Artificial Sequence
  Description of Artificial Sequence: Synthetic oligonucleotide
ugauccugaagcugacgca

SEQ ID NO: 4760 - RNA, 19 nt, Artificial Sequence
  Description of Artificial Sequence: Synthetic oligonucleotide
ugcgucagcuucaggauca

SEQ ID NO: 4761 - RNA, 19 nt, Artificial Sequence
  Description of Artificial Sequence: Synthetic oligonucleotide
gauccugaagcugacgcaa

SEQ ID NO: 4762 - RNA, 19 nt, Artificial Sequence
  Description of Artificial Sequence: Synthetic oligonucleotide
uugcgucagcuucaggauc

SEQ ID NO: 4763 - RNA, 19 nt, Artificial Sequence
  Description of Artificial Sequence: Synthetic oligonucleotide
auccugaagcugacgcaac

SEQ ID NO: 4764 - RNA, 19 nt, Artificial Sequence
  Description of Artificial Sequence: Synthetic oligonucleotide
guugcgucagcuucaggau

SEQ ID NO: 4765 - RNA, 19 nt, Artificial Sequence
  Description of Artificial Sequence: Synthetic oligonucleotide
aaaauccaucagaaucuca

SEQ ID NO: 4766 - RNA, 19 nt, Artificial Sequence
  Description of Artificial Sequence: Synthetic oligonucleotide
ugagauucugauggauuuu

SEQ ID NO: 4767 - RNA, 19 nt, Artificial Sequence
  Description of Artificial Sequence: Synthetic oligonucleotide
cacuaaauaugcuuugaug

SEQ ID NO: 4768 - RNA, 19 nt, Artificial Sequence
  Description of Artificial Sequence: Synthetic oligonucleotide
caucaaagcauauuuagug

SEQ ID NO: 4769 - RNA, 19 nt, Artificial Sequence
  Description of Artificial Sequence: Synthetic oligonucleotide
acuaaauaugcuuugaugc

SEQ ID NO: 4770 - RNA, 19 nt, Artificial Sequence
  Description of Artificial Sequence: Synthetic oligonucleotide
gcaucaaagcauauuuagu

SEQ ID NO: 4771 - RNA, 19 nt, Artificial Sequence
  Description of Artificial Sequence: Synthetic oligonucleotide
cuaaauaugcuuugaugcu

SEQ ID NO: 4772 - RNA, 19 nt, Artificial Sequence
  Description of Artificial Sequence: Synthetic oligonucleotide
agcaucaaagcauauuuag

SEQ ID NO: 4773 - RNA, 19 nt, Artificial Sequence
  Description of Artificial Sequence: Synthetic oligonucleotide
aaauaugcuuugaugcuac

SEQ ID NO: 4774 - RNA, 19 nt, Artificial Sequence
  Description of Artificial Sequence: Synthetic oligonucleotide
guagcaucaaagcauauuu

SEQ ID NO: 4775 - RNA, 19 nt, Artificial Sequence
  Description of Artificial Sequence: Synthetic oligonucleotide
aauaugcuuugaugcuaca

SEQ ID NO: 4776 - RNA, 19 nt, Artificial Sequence
  Description of Artificial Sequence: Synthetic oligonucleotide
uguagcaucaaagcauauu

SEQ ID NO: 4777 - RNA, 19 nt, Artificial Sequence
  Description of Artificial Sequence: Synthetic oligonucleotide
cuucgcuaaaguuacuuca

SEQ ID NO: 4778 - RNA, 19 nt, Artificial Sequence
  Description of Artificial Sequence: Synthetic oligonucleotide
ugaaguaacuuuagcgaag

SEQ ID NO: 4779 - RNA, 19 nt, Artificial Sequence
  Description of Artificial Sequence: Synthetic oligonucleotide
uucgcuaaaguuacuucau

SEQ ID NO: 4780 - RNA, 19 nt, Artificial Sequence
  Description of Artificial Sequence: Synthetic oligonucleotide
augaaguaacuuuagcgaa

SEQ ID NO: 4781 - RNA, 19 nt, Artificial Sequence
  Description of Artificial Sequence: Synthetic oligonucleotide
ucgcuaaaguuacuucauc

SEQ ID NO: 4782 - RNA, 19 nt, Artificial Sequence
  Description of Artificial Sequence: Synthetic oligonucleotide
gaugaaguaacuuuagcga

SEQ ID NO: 4783 - RNA, 19 nt, Artificial Sequence
  Description of Artificial Sequence: Synthetic oligonucleotide
cgcuaaaguuacuucaucu

SEQ ID NO: 4784 - RNA, 19 nt, Artificial Sequence
  Description of Artificial Sequence: Synthetic oligonucleotide
agaugaaguaacuuuagcg

SEQ ID NO: 4785 - RNA, 19 nt, Artificial Sequence
  Description of Artificial Sequence: Synthetic oligonucleotide
uacuucaucuccaucuagc

SEQ ID NO: 4786 - RNA, 19 nt, Artificial Sequence
  Description of Artificial Sequence: Synthetic oligonucleotide
gcuagauggagaugaagua

SEQ ID NO: 4787 - RNA, 19 nt, Artificial Sequence
  Description of Artificial Sequence: Synthetic oligonucleotide
acuucaucuccaucuagca

SEQ ID NO: 4788 - RNA, 19 nt, Artificial Sequence
  Description of Artificial Sequence: Synthetic oligonucleotide
ugcuagauggagaugaagu

SEQ ID NO: 4789 - RNA, 19 nt, Artificial Sequence
  Description of Artificial Sequence: Synthetic oligonucleotide
cuucaucuccaucuagcaa

SEQ ID NO: 4790 - RNA, 19 nt, Artificial Sequence
  Description of Artificial Sequence: Synthetic oligonucleotide
uugcuagauggagaugaag

SEQ ID NO: 4791 - RNA, 19 nt, Artificial Sequence
  Description of Artificial Sequence: Synthetic oligonucleotide
uucaucuccaucuagcaaa

SEQ ID NO: 4792 - RNA, 19 nt, Artificial Sequence
  Description of Artificial Sequence: Synthetic oligonucleotide
uuugcuagauggagaugaa

SEQ ID NO: 4793 - RNA, 19 nt, Artificial Sequence
  Description of Artificial Sequence: Synthetic oligonucleotide
ucaucuccaucuagcaaau

SEQ ID NO: 4794 - RNA, 19 nt, Artificial Sequence
  Description of Artificial Sequence: Synthetic oligonucleotide
auuugcuagauggagauga

SEQ ID NO: 4795 - RNA, 19 nt, Artificial Sequence
  Description of Artificial Sequence: Synthetic oligonucleotide
caucuccaucuagcaaaug

SEQ ID NO: 4796 - RNA, 19 nt, Artificial Sequence
  Description of Artificial Sequence: Synthetic oligonucleotide
cauuugcuagauggagaug

SEQ ID NO: 4797 - RNA, 19 nt, Artificial Sequence
  Description of Artificial Sequence: Synthetic oligonucleotide
uccaucuagcaaaugaggc

SEQ ID NO: 4798 - RNA, 19 nt, Artificial Sequence
  Description of Artificial Sequence: Synthetic oligonucleotide
gccucauuugcuagaugga

SEQ ID NO: 4799 - RNA, 19 nt, Artificial Sequence
  Description of Artificial Sequence: Synthetic oligonucleotide
ccaucuagcaaaugaggca

SEQ ID NO: 4800 - RNA, 19 nt, Artificial Sequence
  Description of Artificial Sequence: Synthetic oligonucleotide
ugccucauuugcuagaugg

SEQ ID NO: 4801 - RNA, 19 nt, Artificial Sequence
  Description of Artificial Sequence: Synthetic oligonucleotide
caucuagcaaaugaggcac

SEQ ID NO: 4802 - RNA, 19 nt, Artificial Sequence
  Description of Artificial Sequence: Synthetic oligonucleotide
gugccucauuugcuagaug

SEQ ID NO: 4803 - RNA, 19 nt, Artificial Sequence
  Description of Artificial Sequence: Synthetic oligonucleotide
ggcacuguucucaaccaaa

SEQ ID NO: 4804 - RNA, 19 nt, Artificial Sequence
  Description of Artificial Sequence: Synthetic oligonucleotide
uuugguugagaacagugcc

SEQ ID NO: 4805 - RNA, 19 nt, Artificial Sequence
  Description of Artificial Sequence: Synthetic oligonucleotide
cuguucucaaccaaaggag

SEQ ID NO: 4806 - RNA, 19 nt, Artificial Sequence
  Description of Artificial Sequence: Synthetic oligonucleotide
cuccuuugguugagaacag

SEQ ID NO: 4807 - RNA, 19 nt, Artificial Sequence
  Description of Artificial Sequence: Synthetic oligonucleotide
cccuuuauaauuugaugug

SEQ ID NO: 4808 - RNA, 19 nt, Artificial Sequence
  Description of Artificial Sequence: Synthetic oligonucleotide
cacaucaaauuauaaaggg

SEQ ID NO: 4809 - RNA, 19 nt, Artificial Sequence
  Description of Artificial Sequence: Synthetic oligonucleotide
ccuuuauaauuugaugugc

SEQ ID NO: 4810 - RNA, 19 nt, Artificial Sequence
  Description of Artificial Sequence: Synthetic oligonucleotide
gcacaucaaauuauaaagg

SEQ ID NO: 4811 - RNA, 19 nt, Artificial Sequence
  Description of Artificial Sequence: Synthetic oligonucleotide
auaauuugaugugcugugg

SEQ ID NO: 4812 - RNA, 19 nt, Artificial Sequence
  Description of Artificial Sequence: Synthetic oligonucleotide
ccacagcacaucaaauuau

SEQ ID NO: 4813 - RNA, 19 nt, Artificial Sequence
  Description of Artificial Sequence: Synthetic oligonucleotide
uuugaugugcuguggucuc

SEQ ID NO: 4814 - RNA, 19 nt, Artificial Sequence
  Description of Artificial Sequence: Synthetic oligonucleotide
gagaccacagcacaucaaa

SEQ ID NO: 4815 - RNA, 19 nt, Artificial Sequence
  Description of Artificial Sequence: Synthetic oligonucleotide
augugcuguggucuccuug

SEQ ID NO: 4816 - RNA, 19 nt, Artificial Sequence
  Description of Artificial Sequence: Synthetic oligonucleotide
caaggagaccacagcacau

SEQ ID NO: 4817 - RNA, 19 nt, Artificial Sequence
  Description of Artificial Sequence: Synthetic oligonucleotide
ugugcuguggucuccuugg

SEQ ID NO: 4818 - RNA, 19 nt, Artificial Sequence
  Description of Artificial Sequence: Synthetic oligonucleotide
ccaaggagaccacagcaca

SEQ ID NO: 4819 - RNA, 19 nt, Artificial Sequence
  Description of Artificial Sequence: Synthetic oligonucleotide
gugcuguggucuccuuggu

SEQ ID NO: 4820 - RNA, 19 nt, Artificial Sequence
  Description of Artificial Sequence: Synthetic oligonucleotide
accaaggagaccacagcac

SEQ ID NO: 4821 - RNA, 19 nt, Artificial Sequence
  Description of Artificial Sequence: Synthetic oligonucleotide
ugcuguggucuccuuggua

SEQ ID NO: 4822 - RNA, 19 nt, Artificial Sequence
  Description of Artificial Sequence: Synthetic oligonucleotide
uaccaaggagaccacagca

SEQ ID NO: 4823 - RNA, 19 nt, Artificial Sequence
  Description of Artificial Sequence: Synthetic oligonucleotide
gcuguggucuccuugguaa

SEQ ID NO: 4824 - RNA, 19 nt, Artificial Sequence
  Description of Artificial Sequence: Synthetic oligonucleotide
uuaccaaggagaccacagc

SEQ ID NO: 4825 - RNA, 19 nt, Artificial Sequence
  Description of Artificial Sequence: Synthetic oligonucleotide
cuguggucuccuugguaau

SEQ ID NO: 4826 - RNA, 19 nt, Artificial Sequence
  Description of Artificial Sequence: Synthetic oligonucleotide
auuaccaaggagaccacag

SEQ ID NO: 4827 - RNA, 19 nt, Artificial Sequence
  Description of Artificial Sequence: Synthetic oligonucleotide
uguggucuccuugguaaug

SEQ ID NO: 4828 - RNA, 19 nt, Artificial Sequence
  Description of Artificial Sequence: Synthetic oligonucleotide
cauuaccaaggagaccaca

SEQ ID NO: 4829 - RNA, 19 nt, Artificial Sequence
  Description of Artificial Sequence: Synthetic oligonucleotide
uaauuugguauugcacagg

SEQ ID NO: 4830 - RNA, 19 nt, Artificial Sequence
  Description of Artificial Sequence: Synthetic oligonucleotide
ccugugcaauaccaaauua

SEQ ID NO: 4831 - RNA, 19 nt, Artificial Sequence
  Description of Artificial Sequence: Synthetic oligonucleotide
aauuugguauugcacaggu

SEQ ID NO: 4832 - RNA, 19 nt, Artificial Sequence
  Description of Artificial Sequence: Synthetic oligonucleotide
accugugcaauaccaaauu

SEQ ID NO: 4833 - RNA, 19 nt, Artificial Sequence
  Description of Artificial Sequence: Synthetic oligonucleotide
auuugguauugcacaggug

SEQ ID NO: 4834 - RNA, 19 nt, Artificial Sequence
  Description of Artificial Sequence: Synthetic oligonucleotide
caccugugcaauaccaaau

SEQ ID NO: 4835 - RNA, 19 nt, Artificial Sequence
  Description of Artificial Sequence: Synthetic oligonucleotide
uuugguauugcacagguga

SEQ ID NO: 4836 - RNA, 19 nt, Artificial Sequence
  Description of Artificial Sequence: Synthetic oligonucleotide
ucaccugugcaauaccaaa

SEQ ID NO: 4837 - RNA, 19 nt, Artificial Sequence
  Description of Artificial Sequence: Synthetic oligonucleotide
uugguauugcacaggugau

SEQ ID NO: 4838 - RNA, 19 nt, Artificial Sequence
  Description of Artificial Sequence: Synthetic oligonucleotide
aucaccugugcaauaccaa

SEQ ID NO: 4839 - RNA, 19 nt, Artificial Sequence
  Description of Artificial Sequence: Synthetic oligonucleotide
ugguauugcacaggugauu

SEQ ID NO: 4840 - RNA, 19 nt, Artificial Sequence
  Description of Artificial Sequence: Synthetic oligonucleotide
aaucaccugugcaauacca

SEQ ID NO: 4841 - RNA, 19 nt, Artificial Sequence
  Description of Artificial Sequence: Synthetic oligonucleotide
gguauugcacaggugauua

SEQ ID NO: 4842 - RNA, 19 nt, Artificial Sequence
  Description of Artificial Sequence: Synthetic oligonucleotide
uaaucaccugugcaauacc

SEQ ID NO: 4843 - RNA, 19 nt, Artificial Sequence
  Description of Artificial Sequence: Synthetic oligonucleotide
guauugcacaggugauuag

SEQ ID NO: 4844 - RNA, 19 nt, Artificial Sequence
  Description of Artificial Sequence: Synthetic oligonucleotide
cuaaucaccugugcaauac

SEQ ID NO: 4845 - RNA, 19 nt, Artificial Sequence
  Description of Artificial Sequence: Synthetic oligonucleotide
uauugcacaggugauuagu

SEQ ID NO: 4846 - RNA, 19 nt, Artificial Sequence
  Description of Artificial Sequence: Synthetic oligonucleotide
acuaaucaccugugcaaua

SEQ ID NO: 4847 - RNA, 19 nt, Artificial Sequence
  Description of Artificial Sequence: Synthetic oligonucleotide
auugcacaggugauuaguc

SEQ ID NO: 4848 - RNA, 19 nt, Artificial Sequence
  Description of Artificial Sequence: Synthetic oligonucleotide
gacuaaucaccugugcaau

SEQ ID NO: 4849 - RNA, 19 nt, Artificial Sequence
  Description of Artificial Sequence: Synthetic oligonucleotide
uugcacaggugauuaguca

SEQ ID NO: 4850 - RNA, 19 nt, Artificial Sequence
  Description of Artificial Sequence: Synthetic oligonucleotide
ugacuaaucaccugugcaa

SEQ ID NO: 4851 - RNA, 19 nt, Artificial Sequence
  Description of Artificial Sequence: Synthetic oligonucleotide
ugcacaggugauuagucaa

SEQ ID NO: 4852 - RNA, 19 nt, Artificial Sequence
  Description of Artificial Sequence: Synthetic oligonucleotide
uugacuaaucaccugugca

SEQ ID NO: 4853 - RNA, 19 nt, Artificial Sequence
  Description of Artificial Sequence: Synthetic oligonucleotide
gcacaggugauuagucaag

SEQ ID NO: 4854 - RNA, 19 nt, Artificial Sequence
  Description of Artificial Sequence: Synthetic oligonucleotide
cuugacuaaucaccugugc

SEQ ID NO: 4855 - RNA, 19 nt, Artificial Sequence
  Description of Artificial Sequence: Synthetic oligonucleotide
cacaggugauuagucaagg

SEQ ID NO: 4856 - RNA, 19 nt, Artificial Sequence
  Description of Artificial Sequence: Synthetic oligonucleotide
ccuugacuaaucaccugug

SEQ ID NO: 4857 - RNA, 19 nt, Artificial Sequence
  Description of Artificial Sequence: Synthetic oligonucleotide
acaggugauuagucaagga

SEQ ID NO: 4858 - RNA, 19 nt, Artificial Sequence
  Description of Artificial Sequence: Synthetic oligonucleotide
uccuugacuaaucaccugu

SEQ ID NO: 4859 - RNA, 19 nt, Artificial Sequence
  Description of Artificial Sequence: Synthetic oligonucleotide
caggugauuagucaaggaa

SEQ ID NO: 4860 - RNA, 19 nt, Artificial Sequence
  Description of Artificial Sequence: Synthetic oligonucleotide
uuccuugacuaaucaccug

SEQ ID NO: 4861 - RNA, 19 nt, Artificial Sequence
  Description of Artificial Sequence: Synthetic oligonucleotide
aggugauuagucaaggaag

SEQ ID NO: 4862 - RNA, 19 nt, Artificial Sequence
  Description of Artificial Sequence: Synthetic oligonucleotide
cuuccuugacuaaucaccu

SEQ ID NO: 4863 - RNA, 19 nt, Artificial Sequence
  Description of Artificial Sequence: Synthetic oligonucleotide
ggugauuagucaaggaagu

SEQ ID NO: 4864 - RNA, 19 nt, Artificial Sequence
  Description of Artificial Sequence: Synthetic oligonucleotide
acuuccuugacuaaucacc

SEQ ID NO: 4865 - RNA, 19 nt, Artificial Sequence
  Description of Artificial Sequence: Synthetic oligonucleotide
gugauuagucaaggaaguc

SEQ ID NO: 4866 - RNA, 19 nt, Artificial Sequence
  Description of Artificial Sequence: Synthetic oligonucleotide
gacuuccuugacuaaucac

SEQ ID NO: 4867 - RNA, 19 nt, Artificial Sequence
  Description of Artificial Sequence: Synthetic oligonucleotide
ugauuagucaaggaagucu

SEQ ID NO: 4868 - RNA, 19 nt, Artificial Sequence
  Description of Artificial Sequence: Synthetic oligonucleotide
agacuuccuugacuaauca

SEQ ID NO: 4869 - RNA, 19 nt, Artificial Sequence
  Description of Artificial Sequence: Synthetic oligonucleotide
gauuagucaaggaagucug

SEQ ID NO: 4870 - RNA, 19 nt, Artificial Sequence
  Description of Artificial Sequence: Synthetic oligonucleotide
cagacuuccuugacuaauc

SEQ ID NO: 4871 - RNA, 19 nt, Artificial Sequence
  Description of Artificial Sequence: Synthetic oligonucleotide
uuagucaaggaagucugga

SEQ ID NO: 4872 - RNA, 19 nt, Artificial Sequence
  Description of Artificial Sequence: Synthetic oligonucleotide
uccagacuuccuugacuaa

SEQ ID NO: 4873 - RNA, 19 nt, Artificial Sequence
  Description of Artificial Sequence: Synthetic oligonucleotide
uagucaaggaagucuggaa

SEQ ID NO: 4874 - RNA, 19 nt, Artificial Sequence
  Description of Artificial Sequence: Synthetic oligonucleotide
uuccagacuuccuugacua

SEQ ID NO: 4875 - RNA, 19 nt, Artificial Sequence
  Description of Artificial Sequence: Synthetic oligonucleotide
cccacagccuugccucaca

SEQ ID NO: 4876 - RNA, 19 nt, Artificial Sequence
  Description of Artificial Sequence: Synthetic oligonucleotide
ugugaggcaaggcuguggg

SEQ ID NO: 4877 - RNA, 19 nt, Artificial Sequence
  Description of Artificial Sequence: Synthetic oligonucleotide
ccacagccuugccucacag

SEQ ID NO: 4878 - RNA, 19 nt, Artificial Sequence
  Description of Artificial Sequence: Synthetic oligonucleotide
cugugaggcaaggcugugg

SEQ ID NO: 4879 - RNA, 19 nt, Artificial Sequence
  Description of Artificial Sequence: Synthetic oligonucleotide
cacagccuugccucacagc

SEQ ID NO: 4880 - RNA, 19 nt, Artificial Sequence
  Description of Artificial Sequence: Synthetic oligonucleotide
gcugugaggcaaggcugug

SEQ ID NO: 4881 - RNA, 19 nt, Artificial Sequence
  Description of Artificial Sequence: Synthetic oligonucleotide
acagccuugccucacagca

SEQ ID NO: 4882 - RNA, 19 nt, Artificial Sequence
  Description of Artificial Sequence: Synthetic oligonucleotide
ugcugugaggcaaggcugu

SEQ ID NO: 4883 - RNA, 19 nt, Artificial Sequence
  Description of Artificial Sequence: Synthetic oligonucleotide
cagccuugccucacagcau

SEQ ID NO: 4884 - RNA, 19 nt, Artificial Sequence
  Description of Artificial Sequence: Synthetic oligonucleotide
augcugugaggcaaggcug

SEQ ID NO: 4885 - RNA, 19 nt, Artificial Sequence
  Description of Artificial Sequence: Synthetic oligonucleotide
agccuugccucacagcaug

SEQ ID NO: 4886 - RNA, 19 nt, Artificial Sequence
  Description of Artificial Sequence: Synthetic oligonucleotide
caugcugugaggcaaggcu

SEQ ID NO: 4887 - RNA, 19 nt, Artificial Sequence
  Description of Artificial Sequence: Synthetic oligonucleotide
gccuugccucacagcaugu

SEQ ID NO: 4888 - RNA, 19 nt, Artificial Sequence
  Description of Artificial Sequence: Synthetic oligonucleotide
acaugcugugaggcaaggc

SEQ ID NO: 4889 - RNA, 19 nt, Artificial Sequence
  Description of Artificial Sequence: Synthetic oligonucleotide
ccuugccucacagcaugua

SEQ ID NO: 4890 - RNA, 19 nt, Artificial Sequence
  Description of Artificial Sequence: Synthetic oligonucleotide
uacaugcugugaggcaagg

SEQ ID NO: 4891 - RNA, 19 nt, Artificial Sequence
  Description of Artificial Sequence: Synthetic oligonucleotide
cuugccucacagcauguaa

SEQ ID NO: 4892 - RNA, 19 nt, Artificial Sequence
  Description of Artificial Sequence: Synthetic oligonucleotide
uuacaugcugugaggcaag

SEQ ID NO: 4893 - RNA, 19 nt, Artificial Sequence
  Description of Artificial Sequence: Synthetic oligonucleotide
uugccucacagcauguaaa

SEQ ID NO: 4894 - RNA, 19 nt, Artificial Sequence
  Description of Artificial Sequence: Synthetic oligonucleotide
uuuacaugcugugaggcaa

SEQ ID NO: 4895 - RNA, 19 nt, Artificial Sequence
  Description of Artificial Sequence: Synthetic oligonucleotide
ugccucacagcauguaaau

SEQ ID NO: 4896 - RNA, 19 nt, Artificial Sequence
  Description of Artificial Sequence: Synthetic oligonucleotide
auuuacaugcugugaggca

SEQ ID NO: 4897 - RNA, 19 nt, Artificial Sequence
  Description of Artificial Sequence: Synthetic oligonucleotide
gccucacagcauguaaaua

SEQ ID NO: 4898 - RNA, 19 nt, Artificial Sequence
  Description of Artificial Sequence: Synthetic oligonucleotide
uauuuacaugcugugaggc

SEQ ID NO: 4899 - RNA, 19 nt, Artificial Sequence
  Description of Artificial Sequence: Synthetic oligonucleotide
ccucacagcauguaaauaa

SEQ ID NO: 4900 - RNA, 19 nt, Artificial Sequence
  Description of Artificial Sequence: Synthetic oligonucleotide
uuauuuacaugcugugagg

SEQ ID NO: 4901 - RNA, 19 nt, Artificial Sequence
  Description of Artificial Sequence: Synthetic oligonucleotide
caauauugaugcugagguu

SEQ ID NO: 4902 - RNA, 19 nt, Artificial Sequence
  Description of Artificial Sequence: Synthetic oligonucleotide
aaccucagcaucaauauug

SEQ ID NO: 4903 - RNA, 19 nt, Artificial Sequence
  Description of Artificial Sequence: Synthetic oligonucleotide
aauauugaugcugagguuc

SEQ ID NO: 4904 - RNA, 19 nt, Artificial Sequence
  Description of Artificial Sequence: Synthetic oligonucleotide
gaaccucagcaucaauauu

SEQ ID NO: 4905 - RNA, 19 nt, Artificial Sequence
  Description of Artificial Sequence: Synthetic oligonucleotide
auauugaugcugagguucu

SEQ ID NO: 4906 - RNA, 19 nt, Artificial Sequence
  Description of Artificial Sequence: Synthetic oligonucleotide
agaaccucagcaucaauau

SEQ ID NO: 4907 - RNA, 19 nt, Artificial Sequence
  Description of Artificial Sequence: Synthetic oligonucleotide
uauugaugcugagguucuu

SEQ ID NO: 4908 - RNA, 19 nt, Artificial Sequence
  Description of Artificial Sequence: Synthetic oligonucleotide
aagaaccucagcaucaaua

SEQ ID NO: 4909 - RNA, 19 nt, Artificial Sequence
  Description of Artificial Sequence: Synthetic oligonucleotide
auugaugcugagguucuuc

SEQ ID NO: 4910 - RNA, 19 nt, Artificial Sequence
  Description of Artificial Sequence: Synthetic oligonucleotide
gaagaaccucagcaucaau

SEQ ID NO: 4911 - RNA, 19 nt, Artificial Sequence
  Description of Artificial Sequence: Synthetic oligonucleotide
uugaugcugagguucuucu

SEQ ID NO: 4912 - RNA, 19 nt, Artificial Sequence
  Description of Artificial Sequence: Synthetic oligonucleotide
agaagaaccucagcaucaa

SEQ ID NO: 4913 - RNA, 19 nt, Artificial Sequence
  Description of Artificial Sequence: Synthetic oligonucleotide
ugaugcugagguucuucua

SEQ ID NO: 4914 - RNA, 19 nt, Artificial Sequence
  Description of Artificial Sequence: Synthetic oligonucleotide
uagaagaaccucagcauca

SEQ ID NO: 4915 - RNA, 19 nt, Artificial Sequence
  Description of Artificial Sequence: Synthetic oligonucleotide
gagguucuucuacugcuag

SEQ ID NO: 4916 - RNA, 19 nt, Artificial Sequence
  Description of Artificial Sequence: Synthetic oligonucleotide
cuagcaguagaagaaccuc

SEQ ID NO: 4917 - RNA, 19 nt, Artificial Sequence
  Description of Artificial Sequence: Synthetic oligonucleotide
agguucuucuacugcuagu

SEQ ID NO: 4918 - RNA, 19 nt, Artificial Sequence
  Description of Artificial Sequence: Synthetic oligonucleotide
acuagcaguagaagaaccu

SEQ ID NO: 4919 - RNA, 19 nt, Artificial Sequence
  Description of Artificial Sequence: Synthetic oligonucleotide
uuuuacuggugugaauugg

SEQ ID NO: 4920 - RNA, 19 nt, Artificial Sequence
  Description of Artificial Sequence: Synthetic oligonucleotide
ccaauucacaccaguaaaa

SEQ ID NO: 4921 - RNA, 19 nt, Artificial Sequence
  Description of Artificial Sequence: Synthetic oligonucleotide
uuuacuggugugaauuggg

SEQ ID NO: 4922 - RNA, 19 nt, Artificial Sequence
  Description of Artificial Sequence: Synthetic oligonucleotide
cccaauucacaccaguaaa

SEQ ID NO: 4923 - RNA, 19 nt, Artificial Sequence
  Description of Artificial Sequence: Synthetic oligonucleotide
uuacuggugugaauuggga

SEQ ID NO: 4924 - RNA, 19 nt, Artificial Sequence
  Description of Artificial Sequence: Synthetic oligonucleotide
ucccaauucacaccaguaa

SEQ ID NO: 4925 - RNA, 19 nt, Artificial Sequence
  Description of Artificial Sequence: Synthetic oligonucleotide
uacuggugugaauugggaa

SEQ ID NO: 4926 - RNA, 19 nt, Artificial Sequence
  Description of Artificial Sequence: Synthetic oligonucleotide
uucccaauucacaccagua

SEQ ID NO: 4927 - RNA, 19 nt, Artificial Sequence
  Description of Artificial Sequence: Synthetic oligonucleotide
cuggugugaauugggaaga

SEQ ID NO: 4928 - RNA, 19 nt, Artificial Sequence
  Description of Artificial Sequence: Synthetic oligonucleotide
ucuucccaauucacaccag

SEQ ID NO: 4929 - RNA, 19 nt, Artificial Sequence
  Description of Artificial Sequence: Synthetic oligonucleotide
uggugugaauugggaagaa

SEQ ID NO: 4930 - RNA, 19 nt, Artificial Sequence
  Description of Artificial Sequence: Synthetic oligonucleotide
uucuucccaauucacacca

SEQ ID NO: 4931 - RNA, 19 nt, Artificial Sequence
  Description of Artificial Sequence: Synthetic oligonucleotide
ugcuauuccaugacguuug

SEQ ID NO: 4932 - RNA, 19 nt, Artificial Sequence
  Description of Artificial Sequence: Synthetic oligonucleotide
caaacgucauggaauagca

SEQ ID NO: 4933 - RNA, 19 nt, Artificial Sequence
  Description of Artificial Sequence: Synthetic oligonucleotide
gcuauuccaugacguuugu

SEQ ID NO: 4934 - RNA, 19 nt, Artificial Sequence
  Description of Artificial Sequence: Synthetic oligonucleotide
acaaacgucauggaauagc

SEQ ID NO: 4935 - RNA, 19 nt, Artificial Sequence
  Description of Artificial Sequence: Synthetic oligonucleotide
cuauuccaugacguuugua

SEQ ID NO: 4936 - RNA, 19 nt, Artificial Sequence
  Description of Artificial Sequence: Synthetic oligonucleotide
uacaaacgucauggaauag

SEQ ID NO: 4937 - RNA, 19 nt, Artificial Sequence
  Description of Artificial Sequence: Synthetic oligonucleotide
uauuccaugacguuuguaa

SEQ ID NO: 4938 - RNA, 19 nt, Artificial Sequence
  Description of Artificial Sequence: Synthetic oligonucleotide
uuacaaacgucauggaaua

SEQ ID NO: 4939 - RNA, 19 nt, Artificial Sequence
  Description of Artificial Sequence: Synthetic oligonucleotide
auuccaugacguuuguaaa

SEQ ID NO: 4940 - RNA, 19 nt, Artificial Sequence
  Description of Artificial Sequence: Synthetic oligonucleotide
uuuacaaacgucauggaau

SEQ ID NO: 4941 - RNA, 19 nt, Artificial Sequence
  Description of Artificial Sequence: Synthetic oligonucleotide
uuccaugacguuuguaaaa

SEQ ID NO: 4942 - RNA, 19 nt, Artificial Sequence
  Description of Artificial Sequence: Synthetic oligonucleotide
uuuuacaaacgucauggaa

SEQ ID NO: 4943 - RNA, 19 nt, Artificial Sequence
  Description of Artificial Sequence: Synthetic oligonucleotide
uccaugacguuuguaaaau

SEQ ID NO: 4944 - RNA, 19 nt, Artificial Sequence
  Description of Artificial Sequence: Synthetic oligonucleotide
auuuuacaaacgucaugga

SEQ ID NO: 4945 - RNA, 19 nt, Artificial Sequence
  Description of Artificial Sequence: Synthetic oligonucleotide
ccaugacguuuguaaaaug

SEQ ID NO: 4946 - RNA, 19 nt, Artificial Sequence
  Description of Artificial Sequence: Synthetic oligonucleotide
cauuuuacaaacgucaugg

SEQ ID NO: 4947 - RNA, 19 nt, Artificial Sequence
  Description of Artificial Sequence: Synthetic oligonucleotide
caugacguuuguaaaaugu

SEQ ID NO: 4948 - RNA, 19 nt, Artificial Sequence
  Description of Artificial Sequence: Synthetic oligonucleotide
acauuuuacaaacgucaug

SEQ ID NO: 4949 - RNA, 19 nt, Artificial Sequence
  Description of Artificial Sequence: Synthetic oligonucleotide
cuugagguuaaauaauggg

SEQ ID NO: 4950 - RNA, 19 nt, Artificial Sequence
  Description of Artificial Sequence: Synthetic oligonucleotide
cccauuauuuaaccucaag

SEQ ID NO: 4951 - RNA, 19 nt, Artificial Sequence
  Description of Artificial Sequence: Synthetic oligonucleotide
uugagguuaaauaaugggu

SEQ ID NO: 4952 - RNA, 19 nt, Artificial Sequence
  Description of Artificial Sequence: Synthetic oligonucleotide
acccauuauuuaaccucaa

SEQ ID NO: 4953 - RNA, 19 nt, Artificial Sequence
  Description of Artificial Sequence: Synthetic oligonucleotide
ugagguuaaauaaugggua

SEQ ID NO: 4954 - RNA, 19 nt, Artificial Sequence
  Description of Artificial Sequence: Synthetic oligonucleotide
uacccauuauuuaaccuca

SEQ ID NO: 4955 - RNA, 19 nt, Artificial Sequence
  Description of Artificial Sequence: Synthetic oligonucleotide
gagguuaaauaauggguag

SEQ ID NO: 4956 - RNA, 19 nt, Artificial Sequence
  Description of Artificial Sequence: Synthetic oligonucleotide
cuacccauuauuuaaccuc

SEQ ID NO: 4957 - RNA, 19 nt, Artificial Sequence
  Description of Artificial Sequence: Synthetic oligonucleotide
agguuaaauaauggguagu

SEQ ID NO: 4958 - RNA, 19 nt, Artificial Sequence
  Description of Artificial Sequence: Synthetic oligonucleotide
acuacccauuauuuaaccu

SEQ ID NO: 4959 - RNA, 19 nt, Artificial Sequence
  Description of Artificial Sequence: Synthetic oligonucleotide
gguuaaauaauggguagua

SEQ ID NO: 4960 - RNA, 19 nt, Artificial Sequence
  Description of Artificial Sequence: Synthetic oligonucleotide
uacuacccauuauuuaacc

SEQ ID NO: 4961 - RNA, 19 nt, Artificial Sequence
  Description of Artificial Sequence: Synthetic oligonucleotide
uaauauuaagguccuugac

SEQ ID NO: 4962 - RNA, 19 nt, Artificial Sequence
  Description of Artificial Sequence: Synthetic oligonucleotide
gucaaggaccuuaauauua

SEQ ID NO: 4963 - RNA, 19 nt, Artificial Sequence
  Description of Artificial Sequence: Synthetic oligonucleotide
aauauuaagguccuugacu

SEQ ID NO: 4964 - RNA, 19 nt, Artificial Sequence
  Description of Artificial Sequence: Synthetic oligonucleotide
agucaaggaccuuaauauu

SEQ ID NO: 4965 - RNA, 19 nt, Artificial Sequence
  Description of Artificial Sequence: Synthetic oligonucleotide
auauuaagguccuugacua

SEQ ID NO: 4966 - RNA, 19 nt, Artificial Sequence
  Description of Artificial Sequence: Synthetic oligonucleotide
uagucaaggaccuuaauau

SEQ ID NO: 4967 - RNA, 19 nt, Artificial Sequence
  Description of Artificial Sequence: Synthetic oligonucleotide
uauuaagguccuugacuau

SEQ ID NO: 4968 - RNA, 19 nt, Artificial Sequence
  Description of Artificial Sequence: Synthetic oligonucleotide
auagucaaggaccuuaaua

SEQ ID NO: 4969 - RNA, 19 nt, Artificial Sequence
  Description of Artificial Sequence: Synthetic oligonucleotide
auuaagguccuugacuaug

SEQ ID NO: 4970 - RNA, 19 nt, Artificial Sequence
  Description of Artificial Sequence: Synthetic oligonucleotide
cauagucaaggaccuuaau

SEQ ID NO: 4971 - RNA, 19 nt, Artificial Sequence
  Description of Artificial Sequence: Synthetic oligonucleotide
agguccuugacuaugugua

SEQ ID NO: 4972 - RNA, 19 nt, Artificial Sequence
  Description of Artificial Sequence: Synthetic oligonucleotide
uacacauagucaaggaccu

SEQ ID NO: 4973 - RNA, 19 nt, Artificial Sequence
  Description of Artificial Sequence: Synthetic oligonucleotide
gguccuugacuauguguac

SEQ ID NO: 4974 - RNA, 19 nt, Artificial Sequence
  Description of Artificial Sequence: Synthetic oligonucleotide
guacacauagucaaggacc

SEQ ID NO: 4975 - RNA, 19 nt, Artificial Sequence
  Description of Artificial Sequence: Synthetic oligonucleotide
uaaucucugccaucucgcu

SEQ ID NO: 4976 - RNA, 19 nt, Artificial Sequence
  Description of Artificial Sequence: Synthetic oligonucleotide
agcgagauggcagagauua

SEQ ID NO: 4977 - RNA, 19 nt, Artificial Sequence
  Description of Artificial Sequence: Synthetic oligonucleotide
aucucugccaucucgcuaa

SEQ ID NO: 4978 - RNA, 19 nt, Artificial Sequence
  Description of Artificial Sequence: Synthetic oligonucleotide
uuagcgagauggcagagau

SEQ ID NO: 4979 - RNA, 19 nt, Artificial Sequence
  Description of Artificial Sequence: Synthetic oligonucleotide
ucucugccaucucgcuaaa

SEQ ID NO: 4980 - RNA, 19 nt, Artificial Sequence
  Description of Artificial Sequence: Synthetic oligonucleotide
uuuagcgagauggcagaga

SEQ ID NO: 4981 - RNA, 19 nt, Artificial Sequence
  Description of Artificial Sequence: Synthetic oligonucleotide
cucugccaucucgcuaaau

SEQ ID NO: 4982 - RNA, 19 nt, Artificial Sequence
  Description of Artificial Sequence: Synthetic oligonucleotide
auuuagcgagauggcagag

SEQ ID NO: 4983 - RNA, 19 nt, Artificial Sequence
  Description of Artificial Sequence: Synthetic oligonucleotide
ucugccaucucgcuaaauc

SEQ ID NO: 4984 - RNA, 19 nt, Artificial Sequence
  Description of Artificial Sequence: Synthetic oligonucleotide
gauuuagcgagauggcaga

SEQ ID NO: 4985 - RNA, 19 nt, Artificial Sequence
  Description of Artificial Sequence: Synthetic oligonucleotide
cugccaucucgcuaaauca

SEQ ID NO: 4986 - RNA, 19 nt, Artificial Sequence
  Description of Artificial Sequence: Synthetic oligonucleotide
ugauuuagcgagauggcag

SEQ ID NO: 4987 - RNA, 19 nt, Artificial Sequence
  Description of Artificial Sequence: Synthetic oligonucleotide
ugccaucucgcuaaaucau

SEQ ID NO: 4988 - RNA, 19 nt, Artificial Sequence
  Description of Artificial Sequence: Synthetic oligonucleotide
augauuuagcgagauggca

SEQ ID NO: 4989 - RNA, 19 nt, Artificial Sequence
  Description of Artificial Sequence: Synthetic oligonucleotide
gccaucucgcuaaaucauc

SEQ ID NO: 4990 - RNA, 19 nt, Artificial Sequence
  Description of Artificial Sequence: Synthetic oligonucleotide
gaugauuuagcgagauggc

SEQ ID NO: 4991 - RNA, 19 nt, Artificial Sequence
  Description of Artificial Sequence: Synthetic oligonucleotide
ccaucucgcuaaaucauca

SEQ ID NO: 4992 - RNA, 19 nt, Artificial Sequence
  Description of Artificial Sequence: Synthetic oligonucleotide
ugaugauuuagcgagaugg

SEQ ID NO: 4993 - RNA, 19 nt, Artificial Sequence
  Description of Artificial Sequence: Synthetic oligonucleotide
aggugccugaucuuccuaa

SEQ ID NO: 4994 - RNA, 19 nt, Artificial Sequence
  Description of Artificial Sequence: Synthetic oligonucleotide
uuaggaagaucaggcaccu

SEQ ID NO: 4995 - RNA, 19 nt, Artificial Sequence
  Description of Artificial Sequence: Synthetic oligonucleotide
ggugccugaucuuccuaau

SEQ ID NO: 4996 - RNA, 19 nt, Artificial Sequence
  Description of Artificial Sequence: Synthetic oligonucleotide
auuaggaagaucaggcacc

SEQ ID NO: 4997 - RNA, 19 nt, Artificial Sequence
  Description of Artificial Sequence: Synthetic oligonucleotide
gugccugaucuuccuaaua

SEQ ID NO: 4998 - RNA, 19 nt, Artificial Sequence
  Description of Artificial Sequence: Synthetic oligonucleotide
uauuaggaagaucaggcac

SEQ ID NO: 4999 - RNA, 19 nt, Artificial Sequence
  Description of Artificial Sequence: Synthetic oligonucleotide
ugccugaucuuccuaauaa

SEQ ID NO: 5000 - RNA, 19 nt, Artificial Sequence
  Description of Artificial Sequence: Synthetic oligonucleotide
uuauuaggaagaucaggca

SEQ ID NO: 5001 - RNA, 19 nt, Artificial Sequence
  Description of Artificial Sequence: Synthetic oligonucleotide
gaucuuccuaauaauucug

SEQ ID NO: 5002 - RNA, 19 nt, Artificial Sequence
  Description of Artificial Sequence: Synthetic oligonucleotide
cagaauuauuaggaagauc

SEQ ID NO: 5003 - RNA, 19 nt, Artificial Sequence
  Description of Artificial Sequence: Synthetic oligonucleotide
aucuuccuaauaauucugc

SEQ ID NO: 5004 - RNA, 19 nt, Artificial Sequence
  Description of Artificial Sequence: Synthetic oligonucleotide
gcagaauuauuaggaagau

SEQ ID NO: 5005 - RNA, 19 nt, Artificial Sequence
  Description of Artificial Sequence: Synthetic oligonucleotide
ucuuccuaauaauucugcc

SEQ ID NO: 5006 - RNA, 19 nt, Artificial Sequence
  Description of Artificial Sequence: Synthetic oligonucleotide
ggcagaauuauuaggaaga

SEQ ID NO: 5007 - RNA, 19 nt, Artificial Sequence
  Description of Artificial Sequence: Synthetic oligonucleotide
cuuccuaauaauucugccu

SEQ ID NO: 5008 - RNA, 19 nt, Artificial Sequence
  Description of Artificial Sequence: Synthetic oligonucleotide
aggcagaauuauuaggaag

SEQ ID NO: 5009 - RNA, 19 nt, Artificial Sequence
  Description of Artificial Sequence: Synthetic oligonucleotide
uuccuaauaauucugccua

SEQ ID NO: 5010 - RNA, 19 nt, Artificial Sequence
  Description of Artificial Sequence: Synthetic oligonucleotide
uaggcagaauuauuaggaa

SEQ ID NO: 5011 - RNA, 19 nt, Artificial Sequence
  Description of Artificial Sequence: Synthetic oligonucleotide
uccuaauaauucugccuau

SEQ ID NO: 5012 - RNA, 19 nt, Artificial Sequence
  Description of Artificial Sequence: Synthetic oligonucleotide
auaggcagaauuauuagga

SEQ ID NO: 5013 - RNA, 19 nt, Artificial Sequence
  Description of Artificial Sequence: Synthetic oligonucleotide
uucugccuauuuucauuug

SEQ ID NO: 5014 - RNA, 19 nt, Artificial Sequence
  Description of Artificial Sequence: Synthetic oligonucleotide
caaaugaaaauaggcagaa

SEQ ID NO: 5015 - RNA, 19 nt, Artificial Sequence
  Description of Artificial Sequence: Synthetic oligonucleotide
ucugccuauuuucauuugc

SEQ ID NO: 5016 - RNA, 19 nt, Artificial Sequence
  Description of Artificial Sequence: Synthetic oligonucleotide
gcaaaugaaaauaggcaga

SEQ ID NO: 5017 - RNA, 19 nt, Artificial Sequence
  Description of Artificial Sequence: Synthetic oligonucleotide
gccuauuuucauuugcuuu

SEQ ID NO: 5018 - RNA, 19 nt, Artificial Sequence
  Description of Artificial Sequence: Synthetic oligonucleotide
aaagcaaaugaaaauaggc

SEQ ID NO: 5019 - RNA, 19 nt, Artificial Sequence
  Description of Artificial Sequence: Synthetic oligonucleotide
auuuucuuucuaguugugg

SEQ ID NO: 5020 - RNA, 19 nt, Artificial Sequence
  Description of Artificial Sequence: Synthetic oligonucleotide
ccacaacuagaaagaaaau

SEQ ID NO: 5021 - RNA, 19 nt, Artificial Sequence
  Description of Artificial Sequence: Synthetic oligonucleotide
uuuucuuucuaguuguggc

SEQ ID NO: 5022 - RNA, 19 nt, Artificial Sequence
  Description of Artificial Sequence: Synthetic oligonucleotide
gccacaacuagaaagaaaa

SEQ ID NO: 5023 - RNA, 19 nt, Artificial Sequence
  Description of Artificial Sequence: Synthetic oligonucleotide
uucuuucuaguuguggcug

SEQ ID NO: 5024 - RNA, 19 nt, Artificial Sequence
  Description of Artificial Sequence: Synthetic oligonucleotide
cagccacaacuagaaagaa

SEQ ID NO: 5025 - RNA, 19 nt, Artificial Sequence
  Description of Artificial Sequence: Synthetic oligonucleotide
ucucccaaauaagaugugc

SEQ ID NO: 5026 - RNA, 19 nt, Artificial Sequence
  Description of Artificial Sequence: Synthetic oligonucleotide
gcacaucuuauuugggaga

SEQ ID NO: 5027 - RNA, 19 nt, Artificial Sequence
  Description of Artificial Sequence: Synthetic oligonucleotide
cucccaaauaagaugugcu

SEQ ID NO: 5028 - RNA, 19 nt, Artificial Sequence
  Description of Artificial Sequence: Synthetic oligonucleotide
agcacaucuuauuugggag

SEQ ID NO: 5029 - RNA, 19 nt, Artificial Sequence
  Description of Artificial Sequence: Synthetic oligonucleotide
aagaugugcugcuuaccga

SEQ ID NO: 5030 - RNA, 19 nt, Artificial Sequence
  Description of Artificial Sequence: Synthetic oligonucleotide
ucgguaagcagcacaucuu

SEQ ID NO: 5031 - RNA, 19 nt, Artificial Sequence
  Description of Artificial Sequence: Synthetic oligonucleotide
agaugugcugcuuaccgag

SEQ ID NO: 5032 - RNA, 19 nt, Artificial Sequence
  Description of Artificial Sequence: Synthetic oligonucleotide
cucgguaagcagcacaucu

SEQ ID NO: 5033 - RNA, 19 nt, Artificial Sequence
  Description of Artificial Sequence: Synthetic oligonucleotide
gaugugcugcuuaccgagg

SEQ ID NO: 5034 - RNA, 19 nt, Artificial Sequence
  Description of Artificial Sequence: Synthetic oligonucleotide
ccucgguaagcagcacauc

SEQ ID NO: 5035 - RNA, 19 nt, Artificial Sequence
  Description of Artificial Sequence: Synthetic oligonucleotide
augugcugcuuaccgaggu

SEQ ID NO: 5036 - RNA, 19 nt, Artificial Sequence
  Description of Artificial Sequence: Synthetic oligonucleotide
accucgguaagcagcacau

SEQ ID NO: 5037 - RNA, 19 nt, Artificial Sequence
  Description of Artificial Sequence: Synthetic oligonucleotide
ugugcugcuuaccgaggua

SEQ ID NO: 5038 - RNA, 19 nt, Artificial Sequence
  Description of Artificial Sequence: Synthetic oligonucleotide
uaccucgguaagcagcaca

SEQ ID NO: 5039 - RNA, 19 nt, Artificial Sequence
  Description of Artificial Sequence: Synthetic oligonucleotide
cugcuuaccgagguaucac

SEQ ID NO: 5040 - RNA, 19 nt, Artificial Sequence
  Description of Artificial Sequence: Synthetic oligonucleotide
gugauaccucgguaagcag

SEQ ID NO: 5041 - RNA, 19 nt, Artificial Sequence
  Description of Artificial Sequence: Synthetic oligonucleotide
ugcuuaccgagguaucacg

SEQ ID NO: 5042 - RNA, 19 nt, Artificial Sequence
  Description of Artificial Sequence: Synthetic oligonucleotide
cgugauaccucgguaagca

SEQ ID NO: 5043 - RNA, 19 nt, Artificial Sequence
  Description of Artificial Sequence: Synthetic oligonucleotide
gcuuaccgagguaucacgg

SEQ ID NO: 5044 - RNA, 19 nt, Artificial Sequence
  Description of Artificial Sequence: Synthetic oligonucleotide
ccgugauaccucgguaagc

SEQ ID NO: 5045 - RNA, 19 nt, Artificial Sequence
  Description of Artificial Sequence: Synthetic oligonucleotide
cuuaccgagguaucacggg

SEQ ID NO: 5046 - RNA, 19 nt, Artificial Sequence
  Description of Artificial Sequence: Synthetic oligonucleotide
cccgugauaccucgguaag

SEQ ID NO: 5047 - RNA, 19 nt, Artificial Sequence
  Description of Artificial Sequence: Synthetic oligonucleotide
ggcuccagcuugggucguu

SEQ ID NO: 5048 - RNA, 19 nt, Artificial Sequence
  Description of Artificial Sequence: Synthetic oligonucleotide
aacgacccaagcuggagcc

SEQ ID NO: 5049 - RNA, 19 nt, Artificial Sequence
  Description of Artificial Sequence: Synthetic oligonucleotide
gcuccagcuugggucguug

SEQ ID NO: 5050 - RNA, 19 nt, Artificial Sequence
  Description of Artificial Sequence: Synthetic oligonucleotide
caacgacccaagcuggagc

SEQ ID NO: 5051 - RNA, 19 nt, Artificial Sequence
  Description of Artificial Sequence: Synthetic oligonucleotide
cuccagcuugggucguuga

SEQ ID NO: 5052 - RNA, 19 nt, Artificial Sequence
  Description of Artificial Sequence: Synthetic oligonucleotide
ucaacgacccaagcuggag

SEQ ID NO: 5053 - RNA, 19 nt, Artificial Sequence
  Description of Artificial Sequence: Synthetic oligonucleotide
uccagcuugggucguugaa

SEQ ID NO: 5054 - RNA, 19 nt, Artificial Sequence
  Description of Artificial Sequence: Synthetic oligonucleotide
uucaacgacccaagcugga

SEQ ID NO: 5055 - RNA, 19 nt, Artificial Sequence
  Description of Artificial Sequence: Synthetic oligonucleotide
ccagcuugggucguugaag

SEQ ID NO: 5056 - RNA, 19 nt, Artificial Sequence
  Description of Artificial Sequence: Synthetic oligonucleotide
cuucaacgacccaagcugg

SEQ ID NO: 5057 - RNA, 19 nt, Artificial Sequence
  Description of Artificial Sequence: Synthetic oligonucleotide
cuugggucguugaagcugg

SEQ ID NO: 5058 - RNA, 19 nt, Artificial Sequence
  Description of Artificial Sequence: Synthetic oligonucleotide
ccagcuucaacgacccaag

SEQ ID NO: 5059 - RNA, 19 nt, Artificial Sequence
  Description of Artificial Sequence: Synthetic oligonucleotide
uugggucguugaagcuggg

SEQ ID NO: 5060 - RNA, 19 nt, Artificial Sequence
  Description of Artificial Sequence: Synthetic oligonucleotide
cccagcuucaacgacccaa

SEQ ID NO: 5061 - RNA, 19 nt, Artificial Sequence
  Description of Artificial Sequence: Synthetic oligonucleotide
cagcaaguuuagcaucuuc

SEQ ID NO: 5062 - RNA, 19 nt, Artificial Sequence
  Description of Artificial Sequence: Synthetic oligonucleotide
gaagaugcuaaacuugcug

SEQ ID NO: 5063 - RNA, 19 nt, Artificial Sequence
  Description of Artificial Sequence: Synthetic oligonucleotide
caaugccaucacuuaacua

SEQ ID NO: 5064 - RNA, 19 nt, Artificial Sequence
  Description of Artificial Sequence: Synthetic oligonucleotide
uaguuaagugauggcauug

SEQ ID NO: 5065 - RNA, 19 nt, Artificial Sequence
  Description of Artificial Sequence: Synthetic oligonucleotide
augccaucacuuaacuaua

SEQ ID NO: 5066 - RNA, 19 nt, Artificial Sequence
  Description of Artificial Sequence: Synthetic oligonucleotide
uauaguuaagugauggcau

SEQ ID NO: 5067 - RNA, 19 nt, Artificial Sequence
  Description of Artificial Sequence: Synthetic oligonucleotide
ugccaucacuuaacuauaa

SEQ ID NO: 5068 - RNA, 19 nt, Artificial Sequence
  Description of Artificial Sequence: Synthetic oligonucleotide
uuauaguuaagugauggca

SEQ ID NO: 5069 - RNA, 19 nt, Artificial Sequence
  Description of Artificial Sequence: Synthetic oligonucleotide
gccaucacuuaacuauaac

SEQ ID NO: 5070 - RNA, 19 nt, Artificial Sequence
  Description of Artificial Sequence: Synthetic oligonucleotide
guuauaguuaagugauggc

SEQ ID NO: 5071 - RNA, 19 nt, Artificial Sequence
  Description of Artificial Sequence: Synthetic oligonucleotide
ccaucacuuaacuauaacu

SEQ ID NO: 5072 - RNA, 19 nt, Artificial Sequence
  Description of Artificial Sequence: Synthetic oligonucleotide
aguuauaguuaagugaugg

SEQ ID NO: 5073 - RNA, 19 nt, Artificial Sequence
  Description of Artificial Sequence: Synthetic oligonucleotide
caucacuuaacuauaacuc

SEQ ID NO: 5074 - RNA, 19 nt, Artificial Sequence
  Description of Artificial Sequence: Synthetic oligonucleotide
gaguuauaguuaagugaug

SEQ ID NO: 5075 - RNA, 19 nt, Artificial Sequence
  Description of Artificial Sequence: Synthetic oligonucleotide
ucucuugaccaaauagacu

SEQ ID NO: 5076 - RNA, 19 nt, Artificial Sequence
  Description of Artificial Sequence: Synthetic oligonucleotide
agucuauuuggucaagaga

SEQ ID NO: 5077 - RNA, 19 nt, Artificial Sequence
  Description of Artificial Sequence: Synthetic oligonucleotide
cucuugaccaaauagacuc

SEQ ID NO: 5078 - RNA, 19 nt, Artificial Sequence
  Description of Artificial Sequence: Synthetic oligonucleotide
gagucuauuuggucaagag

SEQ ID NO: 5079 - RNA, 19 nt, Artificial Sequence
  Description of Artificial Sequence: Synthetic oligonucleotide
ucuugaccaaauagacuca

SEQ ID NO: 5080 - RNA, 19 nt, Artificial Sequence
  Description of Artificial Sequence: Synthetic oligonucleotide
ugagucuauuuggucaaga

SEQ ID NO: 5081 - RNA, 19 nt, Artificial Sequence
  Description of Artificial Sequence: Synthetic oligonucleotide
cuugaccaaauagacucau

SEQ ID NO: 5082 - RNA, 19 nt, Artificial Sequence
  Description of Artificial Sequence: Synthetic oligonucleotide
augagucuauuuggucaag

SEQ ID NO: 5083 - RNA, 19 nt, Artificial Sequence
  Description of Artificial Sequence: Synthetic oligonucleotide
uugaccaaauagacucaua

SEQ ID NO: 5084 - RNA, 19 nt, Artificial Sequence
  Description of Artificial Sequence: Synthetic oligonucleotide
uaugagucuauuuggucaa

SEQ ID NO: 5085 - RNA, 19 nt, Artificial Sequence
  Description of Artificial Sequence: Synthetic oligonucleotide
gaccaaauagacucauaau

SEQ ID NO: 5086 - RNA, 19 nt, Artificial Sequence
  Description of Artificial Sequence: Synthetic oligonucleotide
auuaugagucuauuugguc

SEQ ID NO: 5087 - RNA, 19 nt, Artificial Sequence
  Description of Artificial Sequence: Synthetic oligonucleotide
uuuccuguuguacauuuag

SEQ ID NO: 5088 - RNA, 19 nt, Artificial Sequence
  Description of Artificial Sequence: Synthetic oligonucleotide
cuaaauguacaacaggaaa

SEQ ID NO: 5089 - RNA, 19 nt, Artificial Sequence
  Description of Artificial Sequence: Synthetic oligonucleotide
gguuauucaaaguuuucag

SEQ ID NO: 5090 - RNA, 19 nt, Artificial Sequence
  Description of Artificial Sequence: Synthetic oligonucleotide
cugaaaacuuugaauaacc

SEQ ID NO: 5091 - RNA, 19 nt, Artificial Sequence
  Description of Artificial Sequence: Synthetic oligonucleotide
uauucaaaguuuucagcuc

SEQ ID NO: 5092 - RNA, 19 nt, Artificial Sequence
  Description of Artificial Sequence: Synthetic oligonucleotide
gagcugaaaacuuugaaua

SEQ ID NO: 5093 - RNA, 19 nt, Artificial Sequence
  Description of Artificial Sequence: Synthetic oligonucleotide
auucaaaguuuucagcucu

SEQ ID NO: 5094 - RNA, 19 nt, Artificial Sequence
  Description of Artificial Sequence: Synthetic oligonucleotide
agagcugaaaacuuugaau

SEQ ID NO: 5095 - RNA, 19 nt, Artificial Sequence
  Description of Artificial Sequence: Synthetic oligonucleotide
ucagcucuuuuaaaauugc

SEQ ID NO: 5096 - RNA, 19 nt, Artificial Sequence
  Description of Artificial Sequence: Synthetic oligonucleotide
gcaauuuuaaaagagcuga

SEQ ID NO: 5097 - RNA, 19 nt, Artificial Sequence
  Description of Artificial Sequence: Synthetic oligonucleotide
cagcucuuuuaaaauugcu

SEQ ID NO: 5098 - RNA, 19 nt, Artificial Sequence
  Description of Artificial Sequence: Synthetic oligonucleotide
agcaauuuuaaaagagcug

SEQ ID NO: 5099 - RNA, 19 nt, Artificial Sequence
  Description of Artificial Sequence: Synthetic oligonucleotide
agcucuuuuaaaauugcuc

SEQ ID NO: 5100 - RNA, 19 nt, Artificial Sequence
  Description of Artificial Sequence: Synthetic oligonucleotide
gagcaauuuuaaaagagcu

SEQ ID NO: 5101 - RNA, 19 nt, Artificial Sequence
  Description of Artificial Sequence: Synthetic oligonucleotide
gcucuuuuaaaauugcucu

SEQ ID NO: 5102 - RNA, 19 nt, Artificial Sequence
  Description of Artificial Sequence: Synthetic oligonucleotide
agagcaauuuuaaaagagc

SEQ ID NO: 5103 - RNA, 19 nt, Artificial Sequence
  Description of Artificial Sequence: Synthetic oligonucleotide
aauugcucugaauaaguuc

SEQ ID NO: 5104 - RNA, 19 nt, Artificial Sequence
  Description of Artificial Sequence: Synthetic oligonucleotide
gaacuuauucagagcaauu

SEQ ID NO: 5105 - RNA, 19 nt, Artificial Sequence
  Description of Artificial Sequence: Synthetic oligonucleotide
auugcucugaauaaguucu

SEQ ID NO: 5106 - RNA, 19 nt, Artificial Sequence
  Description of Artificial Sequence: Synthetic oligonucleotide
agaacuuauucagagcaau

SEQ ID NO: 5107 - RNA, 19 nt, Artificial Sequence
  Description of Artificial Sequence: Synthetic oligonucleotide
uugcucugaauaaguucua

SEQ ID NO: 5108 - RNA, 19 nt, Artificial Sequence
  Description of Artificial Sequence: Synthetic oligonucleotide
uagaacuuauucagagcaa

SEQ ID NO: 5109 - RNA, 19 nt, Artificial Sequence
  Description of Artificial Sequence: Synthetic oligonucleotide
ugcucugaauaaguucuag

SEQ ID NO: 5110 - RNA, 19 nt, Artificial Sequence
  Description of Artificial Sequence: Synthetic oligonucleotide
cuagaacuuauucagagca

SEQ ID NO: 5111 - RNA, 19 nt, Artificial Sequence
  Description of Artificial Sequence: Synthetic oligonucleotide
cugaauaaguucuagugag

SEQ ID NO: 5112 - RNA, 19 nt, Artificial Sequence
  Description of Artificial Sequence: Synthetic oligonucleotide
cucacuagaacuuauucag

SEQ ID NO: 5113 - RNA, 19 nt, Artificial Sequence
  Description of Artificial Sequence: Synthetic oligonucleotide
auaaguucuagugagugag

SEQ ID NO: 5114 - RNA, 19 nt, Artificial Sequence
  Description of Artificial Sequence: Synthetic oligonucleotide
cucacucacuagaacuuau

SEQ ID NO: 5115 - RNA, 19 nt, Artificial Sequence
  Description of Artificial Sequence: Synthetic oligonucleotide
uucuagugagugaguuaug

SEQ ID NO: 5116 - RNA, 19 nt, Artificial Sequence
  Description of Artificial Sequence: Synthetic oligonucleotide
cauaacucacucacuagaa

SEQ ID NO: 5117 - RNA, 19 nt, Artificial Sequence
  Description of Artificial Sequence: Synthetic oligonucleotide
ucuagugagugaguuaugg

SEQ ID NO: 5118 - RNA, 19 nt, Artificial Sequence
  Description of Artificial Sequence: Synthetic oligonucleotide
ccauaacucacucacuaga

SEQ ID NO: 5119 - RNA, 19 nt, Artificial Sequence
  Description of Artificial Sequence: Synthetic oligonucleotide
ugaguuauggugcuggcua

SEQ ID NO: 5120 - RNA, 19 nt, Artificial Sequence
  Description of Artificial Sequence: Synthetic oligonucleotide
uagccagcaccauaacuca

SEQ ID NO: 5121 - RNA, 19 nt, Artificial Sequence
  Description of Artificial Sequence: Synthetic oligonucleotide
gaguuauggugcuggcuau

SEQ ID NO: 5122 - RNA, 19 nt, Artificial Sequence
  Description of Artificial Sequence: Synthetic oligonucleotide
auagccagcaccauaacuc

SEQ ID NO: 5123 - RNA, 19 nt, Artificial Sequence
  Description of Artificial Sequence: Synthetic oligonucleotide
aguuauggugcuggcuaua

SEQ ID NO: 5124 - RNA, 19 nt, Artificial Sequence
  Description of Artificial Sequence: Synthetic oligonucleotide
uauagccagcaccauaacu

SEQ ID NO: 5125 - RNA, 19 nt, Artificial Sequence
  Description of Artificial Sequence: Synthetic oligonucleotide
guuauggugcuggcuauau

SEQ ID NO: 5126 - RNA, 19 nt, Artificial Sequence
  Description of Artificial Sequence: Synthetic oligonucleotide
auauagccagcaccauaac

SEQ ID NO: 5127 - RNA, 19 nt, Artificial Sequence
  Description of Artificial Sequence: Synthetic oligonucleotide
uuauggugcuggcuauauu

SEQ ID NO: 5128 - RNA, 19 nt, Artificial Sequence
  Description of Artificial Sequence: Synthetic oligonucleotide
aauauagccagcaccauaa

SEQ ID NO: 5129 - RNA, 19 nt, Artificial Sequence
  Description of Artificial Sequence: Synthetic oligonucleotide
uauggugcuggcuauauuu

SEQ ID NO: 5130 - RNA, 19 nt, Artificial Sequence
  Description of Artificial Sequence: Synthetic oligonucleotide
aaauauagccagcaccaua

SEQ ID NO: 5131 - RNA, 19 nt, Artificial Sequence
  Description of Artificial Sequence: Synthetic oligonucleotide
auggugcuggcuauauuuu

SEQ ID NO: 5132 - RNA, 19 nt, Artificial Sequence
  Description of Artificial Sequence: Synthetic oligonucleotide
aaaauauagccagcaccau

SEQ ID NO: 5133 - RNA, 19 nt, Artificial Sequence
  Description of Artificial Sequence: Synthetic oligonucleotide
uggugcuggcuauauuuug

SEQ ID NO: 5134 - RNA, 19 nt, Artificial Sequence
  Description of Artificial Sequence: Synthetic oligonucleotide
caaaauauagccagcacca

SEQ ID NO: 5135 - RNA, 19 nt, Artificial Sequence
  Description of Artificial Sequence: Synthetic oligonucleotide
ggugcuggcuauauuuugc

SEQ ID NO: 5136 - RNA, 19 nt, Artificial Sequence
  Description of Artificial Sequence: Synthetic oligonucleotide
gcaaaauauagccagcacc

SEQ ID NO: 5137 - RNA, 19 nt, Artificial Sequence
  Description of Artificial Sequence: Synthetic oligonucleotide
ugcccucucaaauguugcu

SEQ ID NO: 5138 - RNA, 19 nt, Artificial Sequence
  Description of Artificial Sequence: Synthetic oligonucleotide
agcaacauuugagagggca

SEQ ID NO: 5139 - RNA, 19 nt, Artificial Sequence
  Description of Artificial Sequence: Synthetic oligonucleotide
gcccucucaaauguugcua

SEQ ID NO: 5140 - RNA, 19 nt, Artificial Sequence
  Description of Artificial Sequence: Synthetic oligonucleotide
uagcaacauuugagagggc

SEQ ID NO: 5141 - RNA, 19 nt, Artificial Sequence
  Description of Artificial Sequence: Synthetic oligonucleotide
cccucucaaauguugcuag

SEQ ID NO: 5142 - RNA, 19 nt, Artificial Sequence
  Description of Artificial Sequence: Synthetic oligonucleotide
cuagcaacauuugagaggg

SEQ ID NO: 5143 - RNA, 19 nt, Artificial Sequence
  Description of Artificial Sequence: Synthetic oligonucleotide
ccucucaaauguugcuagg

SEQ ID NO: 5144 - RNA, 19 nt, Artificial Sequence
  Description of Artificial Sequence: Synthetic oligonucleotide
ccuagcaacauuugagagg

SEQ ID NO: 5145 - RNA, 19 nt, Artificial Sequence
  Description of Artificial Sequence: Synthetic oligonucleotide
cucucaaauguugcuagga

SEQ ID NO: 5146 - RNA, 19 nt, Artificial Sequence
  Description of Artificial Sequence: Synthetic oligonucleotide
uccuagcaacauuugagag

SEQ ID NO: 5147 - RNA, 19 nt, Artificial Sequence
  Description of Artificial Sequence: Synthetic oligonucleotide
aaauguugcuaggaauuca

SEQ ID NO: 5148 - RNA, 19 nt, Artificial Sequence
  Description of Artificial Sequence: Synthetic oligonucleotide
ugaauuccuagcaacauuu

SEQ ID NO: 5149 - RNA, 19 nt, Artificial Sequence
  Description of Artificial Sequence: Synthetic oligonucleotide
aauguugcuaggaauucau

SEQ ID NO: 5150 - RNA, 19 nt, Artificial Sequence
  Description of Artificial Sequence: Synthetic oligonucleotide
augaauuccuagcaacauu

SEQ ID NO: 5151 - RNA, 19 nt, Artificial Sequence
  Description of Artificial Sequence: Synthetic oligonucleotide
auguugcuaggaauucaua

SEQ ID NO: 5152 - RNA, 19 nt, Artificial Sequence
  Description of Artificial Sequence: Synthetic oligonucleotide
uaugaauuccuagcaacau

SEQ ID NO: 5153 - RNA, 19 nt, Artificial Sequence
  Description of Artificial Sequence: Synthetic oligonucleotide
uguugcuaggaauucauac

SEQ ID NO: 5154 - RNA, 19 nt, Artificial Sequence
  Description of Artificial Sequence: Synthetic oligonucleotide
guaugaauuccuagcaaca

SEQ ID NO: 5155 - RNA, 19 nt, Artificial Sequence
  Description of Artificial Sequence: Synthetic oligonucleotide
guugcuaggaauucauacu

SEQ ID NO: 5156 - RNA, 19 nt, Artificial Sequence
  Description of Artificial Sequence: Synthetic oligonucleotide
aguaugaauuccuagcaac

SEQ ID NO: 5157 - RNA, 19 nt, Artificial Sequence
  Description of Artificial Sequence: Synthetic oligonucleotide
uugcuaggaauucauacug

SEQ ID NO: 5158 - RNA, 19 nt, Artificial Sequence
  Description of Artificial Sequence: Synthetic oligonucleotide
caguaugaauuccuagcaa

SEQ ID NO: 5159 - RNA, 19 nt, Artificial Sequence
  Description of Artificial Sequence: Synthetic oligonucleotide
ugcuaggaauucauacugc

SEQ ID NO: 5160 - RNA, 19 nt, Artificial Sequence
  Description of Artificial Sequence: Synthetic oligonucleotide
gcaguaugaauuccuagca

SEQ ID NO: 5161 - RNA, 19 nt, Artificial Sequence
  Description of Artificial Sequence: Synthetic oligonucleotide
aaagcaaugaauaagcaug

SEQ ID NO: 5162 - RNA, 19 nt, Artificial Sequence
  Description of Artificial Sequence: Synthetic oligonucleotide
caugcuuauucauugcuuu

SEQ ID NO: 5163 - RNA, 19 nt, Artificial Sequence
  Description of Artificial Sequence: Synthetic oligonucleotide
aagcaaugaauaagcaugc

SEQ ID NO: 5164 - RNA, 19 nt, Artificial Sequence
  Description of Artificial Sequence: Synthetic oligonucleotide
gcaugcuuauucauugcuu

SEQ ID NO: 5165 - RNA, 19 nt, Artificial Sequence
  Description of Artificial Sequence: Synthetic oligonucleotide
agcaaugaauaagcaugcc

SEQ ID NO: 5166 - RNA, 19 nt, Artificial Sequence
  Description of Artificial Sequence: Synthetic oligonucleotide
ggcaugcuuauucauugcu

SEQ ID NO: 5167 - RNA, 19 nt, Artificial Sequence
  Description of Artificial Sequence: Synthetic oligonucleotide
gcaaugaauaagcaugccu

SEQ ID NO: 5168 - RNA, 19 nt, Artificial Sequence
  Description of Artificial Sequence: Synthetic oligonucleotide
aggcaugcuuauucauugc

SEQ ID NO: 5169 - RNA, 19 nt, Artificial Sequence
  Description of Artificial Sequence: Synthetic oligonucleotide
aaugaauaagcaugccugu

SEQ ID NO: 5170 - RNA, 19 nt, Artificial Sequence
  Description of Artificial Sequence: Synthetic oligonucleotide
acaggcaugcuuauucauu

SEQ ID NO: 5171 - RNA, 19 nt, Artificial Sequence
  Description of Artificial Sequence: Synthetic oligonucleotide
augaauaagcaugccuguu

SEQ ID NO: 5172 - RNA, 19 nt, Artificial Sequence
  Description of Artificial Sequence: Synthetic oligonucleotide
aacaggcaugcuuauucau

SEQ ID NO: 5173 - RNA, 19 nt, Artificial Sequence
  Description of Artificial Sequence: Synthetic oligonucleotide
ugaauaagcaugccuguuu

SEQ ID NO: 5174 - RNA, 19 nt, Artificial Sequence
  Description of Artificial Sequence: Synthetic oligonucleotide
aaacaggcaugcuuauuca

SEQ ID NO: 5175 - RNA, 19 nt, Artificial Sequence
  Description of Artificial Sequence: Synthetic oligonucleotide
gaauaagcaugccuguuuu

SEQ ID NO: 5176 - RNA, 19 nt, Artificial Sequence
  Description of Artificial Sequence: Synthetic oligonucleotide
aaaacaggcaugcuuauuc

SEQ ID NO: 5177 - RNA, 19 nt, Artificial Sequence
  Description of Artificial Sequence: Synthetic oligonucleotide
auaagcaugccuguuuucc

SEQ ID NO: 5178 - RNA, 19 nt, Artificial Sequence
  Description of Artificial Sequence: Synthetic oligonucleotide
ggaaaacaggcaugcuuau

SEQ ID NO: 5179 - RNA, 19 nt, Artificial Sequence
  Description of Artificial Sequence: Synthetic oligonucleotide
augccuguuuucccauggc

SEQ ID NO: 5180 - RNA, 19 nt, Artificial Sequence
  Description of Artificial Sequence: Synthetic oligonucleotide
gccaugggaaaacaggcau

SEQ ID NO: 5181 - RNA, 19 nt, Artificial Sequence
  Description of Artificial Sequence: Synthetic oligonucleotide
ugccuguuuucccauggcc

SEQ ID NO: 5182 - RNA, 19 nt, Artificial Sequence
  Description of Artificial Sequence: Synthetic oligonucleotide
ggccaugggaaaacaggca

SEQ ID NO: 5183 - RNA, 19 nt, Artificial Sequence
  Description of Artificial Sequence: Synthetic oligonucleotide
gccuguuuucccauggccu

SEQ ID NO: 5184 - RNA, 19 nt, Artificial Sequence
  Description of Artificial Sequence: Synthetic oligonucleotide
aggccaugggaaaacaggc

SEQ ID NO: 5185 - RNA, 19 nt, Artificial Sequence
  Description of Artificial Sequence: Synthetic oligonucleotide
ccuguuuucccauggccuu

SEQ ID NO: 5186 - RNA, 19 nt, Artificial Sequence
  Description of Artificial Sequence: Synthetic oligonucleotide
aaggccaugggaaaacagg

SEQ ID NO: 5187 - RNA, 19 nt, Artificial Sequence
  Description of Artificial Sequence: Synthetic oligonucleotide
cuguuuucccauggccuug

SEQ ID NO: 5188 - RNA, 19 nt, Artificial Sequence
  Description of Artificial Sequence: Synthetic oligonucleotide
caaggccaugggaaaacag

SEQ ID NO: 5189 - RNA, 19 nt, Artificial Sequence
  Description of Artificial Sequence: Synthetic oligonucleotide
uucccauggccuugcuugc

SEQ ID NO: 5190 - RNA, 19 nt, Artificial Sequence
  Description of Artificial Sequence: Synthetic oligonucleotide
gcaagcaaggccaugggaa

SEQ ID NO: 5191 - RNA, 19 nt, Artificial Sequence
  Description of Artificial Sequence: Synthetic oligonucleotide
ggccuugcuugccagaauu

SEQ ID NO: 5192 - RNA, 19 nt, Artificial Sequence
  Description of Artificial Sequence: Synthetic oligonucleotide
aauucuggcaagcaaggcc

SEQ ID NO: 5193 - RNA, 19 nt, Artificial Sequence
  Description of Artificial Sequence: Synthetic oligonucleotide
uugcuugccagaauuugac

SEQ ID NO: 5194 - RNA, 19 nt, Artificial Sequence
  Description of Artificial Sequence: Synthetic oligonucleotide
gucaaauucuggcaagcaa

SEQ ID NO: 5195 - RNA, 19 nt, Artificial Sequence
  Description of Artificial Sequence: Synthetic oligonucleotide
ugcuugccagaauuugacu

SEQ ID NO: 5196 - RNA, 19 nt, Artificial Sequence
  Description of Artificial Sequence: Synthetic oligonucleotide
agucaaauucuggcaagca

SEQ ID NO: 5197 - RNA, 19 nt, Artificial Sequence
  Description of Artificial Sequence: Synthetic oligonucleotide
gcuugccagaauuugacuu

SEQ ID NO: 5198 - RNA, 19 nt, Artificial Sequence
  Description of Artificial Sequence: Synthetic oligonucleotide
aagucaaauucuggcaagc

SEQ ID NO: 5199 - RNA, 19 nt, Artificial Sequence
  Description of Artificial Sequence: Synthetic oligonucleotide
cuugccagaauuugacuuu

SEQ ID NO: 5200 - RNA, 19 nt, Artificial Sequence
  Description of Artificial Sequence: Synthetic oligonucleotide
aaagucaaauucuggcaag

SEQ ID NO: 5201 - RNA, 19 nt, Artificial Sequence
  Description of Artificial Sequence: Synthetic oligonucleotide
uugccagaauuugacuuuu

SEQ ID NO: 5202 - RNA, 19 nt, Artificial Sequence
  Description of Artificial Sequence: Synthetic oligonucleotide
aaaagucaaauucuggcaa

SEQ ID NO: 5203 - RNA, 19 nt, Artificial Sequence
  Description of Artificial Sequence: Synthetic oligonucleotide
gauauacuacuauugcuug

SEQ ID NO: 5204 - RNA, 19 nt, Artificial Sequence
  Description of Artificial Sequence: Synthetic oligonucleotide
caagcaauaguaguauauc

SEQ ID NO: 5205 - RNA, 19 nt, Artificial Sequence
  Description of Artificial Sequence: Synthetic oligonucleotide
auauugugguauacggugu

SEQ ID NO: 5206 - RNA, 19 nt, Artificial Sequence
  Description of Artificial Sequence: Synthetic oligonucleotide
acaccguauaccacaauau

SEQ ID NO: 5207 - RNA, 19 nt, Artificial Sequence
  Description of Artificial Sequence: Synthetic oligonucleotide
uauugugguauacgguguc

SEQ ID NO: 5208 - RNA, 19 nt, Artificial Sequence
  Description of Artificial Sequence: Synthetic oligonucleotide
gacaccguauaccacaaua

SEQ ID NO: 5209 - RNA, 19 nt, Artificial Sequence
  Description of Artificial Sequence: Synthetic oligonucleotide
auugugguauacgguguca

SEQ ID NO: 5210 - RNA, 19 nt, Artificial Sequence
  Description of Artificial Sequence: Synthetic oligonucleotide
ugacaccguauaccacaau

SEQ ID NO: 5211 - RNA, 19 nt, Artificial Sequence
  Description of Artificial Sequence: Synthetic oligonucleotide
uugugguauacggugucag

SEQ ID NO: 5212 - RNA, 19 nt, Artificial Sequence
  Description of Artificial Sequence: Synthetic oligonucleotide
cugacaccguauaccacaa

SEQ ID NO: 5213 - RNA, 19 nt, Artificial Sequence
  Description of Artificial Sequence: Synthetic oligonucleotide
ugugguauacggugucagg

SEQ ID NO: 5214 - RNA, 19 nt, Artificial Sequence
  Description of Artificial Sequence: Synthetic oligonucleotide
ccugacaccguauaccaca

SEQ ID NO: 5215 - RNA, 19 nt, Artificial Sequence
  Description of Artificial Sequence: Synthetic oligonucleotide
gugguauacggugucaggu

SEQ ID NO: 5216 - RNA, 19 nt, Artificial Sequence
  Description of Artificial Sequence: Synthetic oligonucleotide
accugacaccguauaccac

SEQ ID NO: 5217 - RNA, 19 nt, Artificial Sequence
  Description of Artificial Sequence: Synthetic oligonucleotide
uauacggugucagguuuca

SEQ ID NO: 5218 - RNA, 19 nt, Artificial Sequence
  Description of Artificial Sequence: Synthetic oligonucleotide
ugaaaccugacaccguaua

SEQ ID NO: 5219 - RNA, 19 nt, Artificial Sequence
  Description of Artificial Sequence: Synthetic oligonucleotide
auacggugucagguuucag

SEQ ID NO: 5220 - RNA, 19 nt, Artificial Sequence
  Description of Artificial Sequence: Synthetic oligonucleotide
cugaaaccugacaccguau

SEQ ID NO: 5221 - RNA, 19 nt, Artificial Sequence
  Description of Artificial Sequence: Synthetic oligonucleotide
uacggugucagguuucagg

SEQ ID NO: 5222 - RNA, 19 nt, Artificial Sequence
  Description of Artificial Sequence: Synthetic oligonucleotide
ccugaaaccugacaccgua

SEQ ID NO: 5223 - RNA, 19 nt, Artificial Sequence
  Description of Artificial Sequence: Synthetic oligonucleotide
ugucagguuucaggguuuu

SEQ ID NO: 5224 - RNA, 19 nt, Artificial Sequence
  Description of Artificial Sequence: Synthetic oligonucleotide
aaaacccugaaaccugaca

SEQ ID NO: 5225 - RNA, 19 nt, Artificial Sequence
  Description of Artificial Sequence: Synthetic oligonucleotide
uucauuucaaauacucccu

SEQ ID NO: 5226 - RNA, 19 nt, Artificial Sequence
  Description of Artificial Sequence: Synthetic oligonucleotide
agggaguauuugaaaugaa

SEQ ID NO: 5227 - RNA, 19 nt, Artificial Sequence
  Description of Artificial Sequence: Synthetic oligonucleotide
cauuucaaauacucccuuu

SEQ ID NO: 5228 - RNA, 19 nt, Artificial Sequence
  Description of Artificial Sequence: Synthetic oligonucleotide
aaagggaguauuugaaaug

SEQ ID NO: 5229 - RNA, 19 nt, Artificial Sequence
  Description of Artificial Sequence: Synthetic oligonucleotide
uagguauaacuguugauga

SEQ ID NO: 5230 - RNA, 19 nt, Artificial Sequence
  Description of Artificial Sequence: Synthetic oligonucleotide
ucaucaacaguuauaccua

SEQ ID NO: 5231 - RNA, 19 nt, Artificial Sequence
  Description of Artificial Sequence: Synthetic oligonucleotide
agguauaacuguugaugaa

SEQ ID NO: 5232 - RNA, 19 nt, Artificial Sequence
  Description of Artificial Sequence: Synthetic oligonucleotide
uucaucaacaguuauaccu

SEQ ID NO: 5233 - RNA, 19 nt, Artificial Sequence
  Description of Artificial Sequence: Synthetic oligonucleotide
uuauuguccauuuauaccc

SEQ ID NO: 5234 - RNA, 19 nt, Artificial Sequence
  Description of Artificial Sequence: Synthetic oligonucleotide
ggguauaaauggacaauaa

SEQ ID NO: 5235 - RNA, 19 nt, Artificial Sequence
  Description of Artificial Sequence: Synthetic oligonucleotide
uauuguccauuuauacccu

SEQ ID NO: 5236 - RNA, 19 nt, Artificial Sequence
  Description of Artificial Sequence: Synthetic oligonucleotide
aggguauaaauggacaaua

SEQ ID NO: 5237 - RNA, 19 nt, Artificial Sequence
  Description of Artificial Sequence: Synthetic oligonucleotide
auuguccauuuauacccug

SEQ ID NO: 5238 - RNA, 19 nt, Artificial Sequence
  Description of Artificial Sequence: Synthetic oligonucleotide
caggguauaaauggacaau

SEQ ID NO: 5239 - RNA, 19 nt, Artificial Sequence
  Description of Artificial Sequence: Synthetic oligonucleotide
uuguccauuuauacccugu

SEQ ID NO: 5240 - RNA, 19 nt, Artificial Sequence
  Description of Artificial Sequence: Synthetic oligonucleotide
acaggguauaaauggacaa

SEQ ID NO: 5241 - RNA, 19 nt, Artificial Sequence
  Description of Artificial Sequence: Synthetic oligonucleotide
uguccauuuauacccugua

SEQ ID NO: 5242 - RNA, 19 nt, Artificial Sequence
  Description of Artificial Sequence: Synthetic oligonucleotide
uacaggguauaaauggaca

SEQ ID NO: 5243 - RNA, 19 nt, Artificial Sequence
  Description of Artificial Sequence: Synthetic oligonucleotide
guccauuuauacccuguaa

SEQ ID NO: 5244 - RNA, 19 nt, Artificial Sequence
  Description of Artificial Sequence: Synthetic oligonucleotide
uuacaggguauaaauggac

SEQ ID NO: 5245 - RNA, 19 nt, Artificial Sequence
  Description of Artificial Sequence: Synthetic oligonucleotide
uauacccuguaaagccguu

SEQ ID NO: 5246 - RNA, 19 nt, Artificial Sequence
  Description of Artificial Sequence: Synthetic oligonucleotide
aacggcuuuacaggguaua

SEQ ID NO: 5247 - RNA, 19 nt, Artificial Sequence
  Description of Artificial Sequence: Synthetic oligonucleotide
auacccuguaaagccguuu

SEQ ID NO: 5248 - RNA, 19 nt, Artificial Sequence
  Description of Artificial Sequence: Synthetic oligonucleotide
aaacggcuuuacaggguau

SEQ ID NO: 5249 - RNA, 19 nt, Artificial Sequence
  Description of Artificial Sequence: Synthetic oligonucleotide
uacccuguaaagccguuuu

SEQ ID NO: 5250 - RNA, 19 nt, Artificial Sequence
  Description of Artificial Sequence: Synthetic oligonucleotide
aaaacggcuuuacagggua

SEQ ID NO: 5251 - RNA, 19 nt, Artificial Sequence
  Description of Artificial Sequence: Synthetic oligonucleotide
agccguuuuagaauguaau

SEQ ID NO: 5252 - RNA, 19 nt, Artificial Sequence
  Description of Artificial Sequence: Synthetic oligonucleotide
auuacauucuaaaacggcu

SEQ ID NO: 5253 - RNA, 19 nt, Artificial Sequence
  Description of Artificial Sequence: Synthetic oligonucleotide
gccguuuuagaauguaaua

SEQ ID NO: 5254 - RNA, 19 nt, Artificial Sequence
  Description of Artificial Sequence: Synthetic oligonucleotide
uauuacauucuaaaacggc

SEQ ID NO: 5255 - RNA, 19 nt, Artificial Sequence
  Description of Artificial Sequence: Synthetic oligonucleotide
agguaauccaaaauguacu

SEQ ID NO: 5256 - RNA, 19 nt, Artificial Sequence
  Description of Artificial Sequence: Synthetic oligonucleotide
aguacauuuuggauuaccu

SEQ ID NO: 5257 - RNA, 19 nt, Artificial Sequence
  Description of Artificial Sequence: Synthetic oligonucleotide
gguaauccaaaauguacua

SEQ ID NO: 5258 - RNA, 19 nt, Artificial Sequence
  Description of Artificial Sequence: Synthetic oligonucleotide
uaguacauuuuggauuacc

SEQ ID NO: 5259 - RNA, 19 nt, Artificial Sequence
  Description of Artificial Sequence: Synthetic oligonucleotide
acauuuguauugucucuuc

SEQ ID NO: 5260 - RNA, 19 nt, Artificial Sequence
  Description of Artificial Sequence: Synthetic oligonucleotide
gaagagacaauacaaaugu

SEQ ID NO: 5261 - RNA, 19 nt, Artificial Sequence
  Description of Artificial Sequence: Synthetic oligonucleotide
cauuuguauugucucuucu

SEQ ID NO: 5262 - RNA, 19 nt, Artificial Sequence
  Description of Artificial Sequence: Synthetic oligonucleotide
agaagagacaauacaaaug

SEQ ID NO: 5263 - RNA, 19 nt, Artificial Sequence
  Description of Artificial Sequence: Synthetic oligonucleotide
uuguaucgcaaagcuauau

SEQ ID NO: 5264 - RNA, 19 nt, Artificial Sequence
  Description of Artificial Sequence: Synthetic oligonucleotide
auauagcuuugcgauacaa

SEQ ID NO: 5265 - RNA, 19 nt, Artificial Sequence
  Description of Artificial Sequence: Synthetic oligonucleotide
uguaucgcaaagcuauaug

SEQ ID NO: 5266 - RNA, 19 nt, Artificial Sequence
  Description of Artificial Sequence: Synthetic oligonucleotide
cauauagcuuugcgauaca

SEQ ID NO: 5267 - RNA, 19 nt, Artificial Sequence
  Description of Artificial Sequence: Synthetic oligonucleotide
guaucgcaaagcuauaugu

SEQ ID NO: 5268 - RNA, 19 nt, Artificial Sequence
  Description of Artificial Sequence: Synthetic oligonucleotide
acauauagcuuugcgauac

SEQ ID NO: 5269 - RNA, 19 nt, Artificial Sequence
  Description of Artificial Sequence: Synthetic oligonucleotide
uaucgcaaagcuauaugug

SEQ ID NO: 5270 - RNA, 19 nt, Artificial Sequence
  Description of Artificial Sequence: Synthetic oligonucleotide
cacauauagcuuugcgaua

SEQ ID NO: 5271 - RNA, 19 nt, Artificial Sequence
  Description of Artificial Sequence: Synthetic oligonucleotide
aucgcaaagcuauaugugc

SEQ ID NO: 5272 - RNA, 19 nt, Artificial Sequence
  Description of Artificial Sequence: Synthetic oligonucleotide
gcacauauagcuuugcgau

SEQ ID NO: 5273 - RNA, 19 nt, Artificial Sequence
  Description of Artificial Sequence: Synthetic oligonucleotide
ucgcaaagcuauaugugca

SEQ ID NO: 5274 - RNA, 19 nt, Artificial Sequence
  Description of Artificial Sequence: Synthetic oligonucleotide
ugcacauauagcuuugcga

SEQ ID NO: 5275 - RNA, 19 nt, Artificial Sequence
  Description of Artificial Sequence: Synthetic oligonucleotide
ugaucuaugcuuugaguuu

SEQ ID NO: 5276 - RNA, 19 nt, Artificial Sequence
  Description of Artificial Sequence: Synthetic oligonucleotide
aaacucaaagcauagauca

SEQ ID NO: 5277 - RNA, 19 nt, Artificial Sequence
  Description of Artificial Sequence: Synthetic oligonucleotide
gaucuaugcuuugaguuug

SEQ ID NO: 5278 - RNA, 19 nt, Artificial Sequence
  Description of Artificial Sequence: Synthetic oligonucleotide
caaacucaaagcauagauc

SEQ ID NO: 5279 - RNA, 19 nt, Artificial Sequence
  Description of Artificial Sequence: Synthetic oligonucleotide
aucuaugcuuugaguuugc

SEQ ID NO: 5280 - RNA, 19 nt, Artificial Sequence
  Description of Artificial Sequence: Synthetic oligonucleotide
gcaaacucaaagcauagau

SEQ ID NO: 5281 - RNA, 19 nt, Artificial Sequence
  Description of Artificial Sequence: Synthetic oligonucleotide
ucuaugcuuugaguuugcu

SEQ ID NO: 5282 - RNA, 19 nt, Artificial Sequence
  Description of Artificial Sequence: Synthetic oligonucleotide
agcaaacucaaagcauaga

SEQ ID NO: 5283 - RNA, 19 nt, Artificial Sequence
  Description of Artificial Sequence: Synthetic oligonucleotide
cuaugcuuugaguuugcuu

SEQ ID NO: 5284 - RNA, 19 nt, Artificial Sequence
  Description of Artificial Sequence: Synthetic oligonucleotide
aagcaaacucaaagcauag

SEQ ID NO: 5285 - RNA, 19 nt, Artificial Sequence
  Description of Artificial Sequence: Synthetic oligonucleotide
uaugcuuugaguuugcuuu

SEQ ID NO: 5286 - RNA, 19 nt, Artificial Sequence
  Description of Artificial Sequence: Synthetic oligonucleotide
aaagcaaacucaaagcaua

SEQ ID NO: 5287 - RNA, 19 nt, Artificial Sequence
  Description of Artificial Sequence: Synthetic oligonucleotide
augcuuugaguuugcuuuc

SEQ ID NO: 5288 - RNA, 19 nt, Artificial Sequence
  Description of Artificial Sequence: Synthetic oligonucleotide
gaaagcaaacucaaagcau

SEQ ID NO: 5289 - RNA, 19 nt, Artificial Sequence
  Description of Artificial Sequence: Synthetic oligonucleotide
aucuuaccuaaaaguacug

SEQ ID NO: 5290 - RNA, 19 nt, Artificial Sequence
  Description of Artificial Sequence: Synthetic oligonucleotide
caguacuuuuagguaagau

SEQ ID NO: 5291 - RNA, 19 nt, Artificial Sequence
  Description of Artificial Sequence: Synthetic oligonucleotide
cuuaccuaaaaguacugaa

SEQ ID NO: 5292 - RNA, 19 nt, Artificial Sequence
  Description of Artificial Sequence: Synthetic oligonucleotide
uucaguacuuuuagguaag

SEQ ID NO: 5293 - RNA, 20 nt, Artificial Sequence
  Description of Artificial Sequence: Synthetic oligonucleotide
gucacugcuugcagccugag

SEQ ID NO: 5294 - RNA, 20 nt, Artificial Sequence
  Description of Artificial Sequence: Synthetic oligonucleotide
ugucacugcuugcagccuga

SEQ ID NO: 5295 - RNA, 20 nt, Artificial Sequence
  Description of Artificial Sequence: Synthetic oligonucleotide
cugucacugcuugcagccug

SEQ ID NO: 5296 - RNA, 20 nt, Artificial Sequence
  Description of Artificial Sequence: Synthetic oligonucleotide
acugucacugcuugcagccu

SEQ ID NO: 5297 - RNA, 20 nt, Artificial Sequence
  Description of Artificial Sequence: Synthetic oligonucleotide
cacugucacugcuugcagcc

SEQ ID NO: 5298 - RNA, 20 nt, Artificial Sequence
  Description of Artificial Sequence: Synthetic oligonucleotide
gcacugucacugcuugcagc

SEQ ID NO: 5299 - RNA, 20 nt, Artificial Sequence
  Description of Artificial Sequence: Synthetic oligonucleotide
ggcacugucacugcuugcag

SEQ ID NO: 5300 - RNA, 20 nt, Artificial Sequence
  Description of Artificial Sequence: Synthetic oligonucleotide
gggcacugucacugcuugca

SEQ ID NO: 5301 - RNA, 20 nt, Artificial Sequence
  Description of Artificial Sequence: Synthetic oligonucleotide
ugggcacugucacugcuugc

SEQ ID NO: 5302 - RNA, 20 nt, Artificial Sequence
  Description of Artificial Sequence: Synthetic oligonucleotide
ucucacacuuuacaagcugu

SEQ ID NO: 5303 - RNA, 20 nt, Artificial Sequence
  Description of Artificial Sequence: Synthetic oligonucleotide
gucucacacuuuacaagcug

SEQ ID NO: 5304 - RNA, 20 nt, Artificial Sequence
  Description of Artificial Sequence: Synthetic oligonucleotide
ugucucacacuuuacaagcu

SEQ ID NO: 5305 - RNA, 20 nt, Artificial Sequence
  Description of Artificial Sequence: Synthetic oligonucleotide
cugucucacacuuuacaagc

SEQ ID NO: 5306 - RNA, 20 nt, Artificial Sequence
  Description of Artificial Sequence: Synthetic oligonucleotide
gcugucucacacuuuacaag

SEQ ID NO: 5307 - RNA, 20 nt, Artificial Sequence
  Description of Artificial Sequence: Synthetic oligonucleotide
agcugucucacacuuuacaa

SEQ ID NO: 5308 - RNA, 19 nt, Artificial Sequence
  Description of Artificial Sequence: Synthetic oligonucleotide
ggcugcaagcagugacagu

SEQ ID NO: 5309 - RNA, 19 nt, Artificial Sequence
  Description of Artificial Sequence: Synthetic oligonucleotide
acugucacugcuugcagcc

SEQ ID NO: 5310 - RNA, 19 nt, Artificial Sequence
  Description of Artificial Sequence: Synthetic oligonucleotide
gcugcaagcagugacagug

SEQ ID NO: 5311 - RNA, 19 nt, Artificial Sequence
  Description of Artificial Sequence: Synthetic oligonucleotide
cacugucacugcuugcagc

SEQ ID NO: 5312 - RNA, 19 nt, Artificial Sequence
  Description of Artificial Sequence: Synthetic oligonucleotide
cugcaagcagugacagugc

SEQ ID NO: 5313 - RNA, 19 nt, Artificial Sequence
  Description of Artificial Sequence: Synthetic oligonucleotide
gcacugucacugcuugcag

SEQ ID NO: 5314 - RNA, 19 nt, Artificial Sequence
  Description of Artificial Sequence: Synthetic oligonucleotide
ugcaagcagugacagugcc

SEQ ID NO: 5315 - RNA, 19 nt, Artificial Sequence
  Description of Artificial Sequence: Synthetic oligonucleotide
ggcacugucacugcuugca

SEQ ID NO: 5316 - RNA, 19 nt, Artificial Sequence
  Description of Artificial Sequence: Synthetic oligonucleotide
gcaagcagugacagugccc

SEQ ID NO: 5317 - RNA, 19 nt, Artificial Sequence
  Description of Artificial Sequence: Synthetic oligonucleotide
gggcacugucacugcuugc

SEQ ID NO: 5318 - RNA, 19 nt, Artificial Sequence
  Description of Artificial Sequence: Synthetic oligonucleotide
caagcagugacagugccca

SEQ ID NO: 5319 - RNA, 19 nt, Artificial Sequence
  Description of Artificial Sequence: Synthetic oligonucleotide
ugggcacugucacugcuug

SEQ ID NO: 5320 - RNA, 19 nt, Artificial Sequence
  Description of Artificial Sequence: Synthetic oligonucleotide
cucacagcuuguaaagugu

SEQ ID NO: 5321 - RNA, 19 nt, Artificial Sequence
  Description of Artificial Sequence: Synthetic oligonucleotide
acacuuuacaagcugugag

SEQ ID NO: 5322 - RNA, 20 nt, Artificial Sequence
  Description of Artificial Sequence: Synthetic oligonucleotide
ugcacgcagccugagaguag

SEQ ID NO: 5323 - RNA, 20 nt, Artificial Sequence
  Description of Artificial Sequence: Synthetic oligonucleotide
cugcacgcagccugagagua

SEQ ID NO: 5324 - RNA, 19 nt, Artificial Sequence
  Description of Artificial Sequence: Synthetic oligonucleotide
cuacucucaggcugcgugc

SEQ ID NO: 5325 - RNA, 19 nt, Artificial Sequence
  Description of Artificial Sequence: Synthetic oligonucleotide
gcacgcagccugagaguag

SEQ ID NO: 5326 - RNA, 19 nt, Artificial Sequence
  Description of Artificial Sequence: Synthetic oligonucleotide
uacucucaggcugcgugca

SEQ ID NO: 5327 - RNA, 19 nt, Artificial Sequence
  Description of Artificial Sequence: Synthetic oligonucleotide
ugcacgcagccugagagua

SEQ ID NO: 5328 - RNA, 20 nt, Artificial Sequence
  Description of Artificial Sequence: Synthetic oligonucleotide
gcugucucaggcuuuacaag

SEQ ID NO: 5329 - RNA, 20 nt, Artificial Sequence
  Description of Artificial Sequence: Synthetic oligonucleotide
agcugucucaggcuuuacaa

SEQ ID NO: 5330 - RNA, 19 nt, Artificial Sequence
  Description of Artificial Sequence: Synthetic oligonucleotide
ugcucucaggcugcgugca

SEQ ID NO: 5331 - RNA, 19 nt, Artificial Sequence
  Description of Artificial Sequence: Synthetic oligonucleotide
ugcacgcagccugagagca

What is claimed is:

1. A method of treating a subject having Birdshot Chorioretinopathy (BSCR), the method comprising administering to the subject an Endoplasmic Reticulum Aminopeptidase 2 (ERAP2) inhibitor, wherein the ERAP2 inhibitor comprises an ERAP2 siRNA comprising a sense strand having a nucleotide sequence set forth in one of odd-numbered SEQ ID NOs: 859-2748 and a corresponding antisense strand having a nucleotide sequence set forth in even-numbered SEQ ID NOs: 859-2748; and wherein the subject has at least one HLA-Aw19 allele.

2. The method according to claim 1, wherein the ERAP2 inhibitory nucleic acid molecule comprises an ERAP2 small interfering RNA (siRNA).

3. The method according to claim 1, wherein the subject has a plurality of HLA-Aw19 alleles.

4. The method according to claim 1, wherein the at least one HLA-Aw19 allele comprises at least one HLA-A*29 allele, at least one HLA-A*30 allele, at least one HLA-A*31 allele, or at least one HLA-A*33 allele.

5. The method according to claim 1, wherein the at least one HLA-Aw19 allele comprises at least one HLA-A*29 allele.

6. The method according to claim 1, wherein the at least one HLA-Aw19 allele comprises:

i) at least one HLA-A*29 allele and at least one HLA-A*30 allele;

ii) at least one HLA-A*29 allele and at least one HLA-A*31 allele; or iii) at least one HLA-A*29 allele and at least one HLA-A*33 allele.

* * * * *